United States Patent 12,642,819 (COMPOSITIONS AND METHODS FOR TREATING INFLAMMATORY BOWEL DISEASE) - sequence listing, part 95

SEQ ID NO: 50 - DNA, 4770092 bp, Parabacteroides distasonis (residues 1-1,590,031 of 4,770,092)
gaacaagcgggaatggattaatattaatactaaagtaataaattaaagttcatccgtcgttacctccgtgaggagagagggcggtaagaataagtcttggttggcattgtatatgccgccaagactttattccatatgttgtattgttaatctaaaaattaaaggatatgcagtttagttggtggtacctttttgtttctatccctgtgatatggtctttatggataggtttccgggtctttagggggataaataaaccaagtgatttcttctggtatccggaaggaatgtcatcagagaagttgagggattctttgaccgcatcgaatatcagtgtaggttctgctatctttgcgtttttgagctttggatattcttataagcttgccgcttttatctctcctttgacatggctgctgggtttctttatcttgtataaggtatttcctcgtatagaaaattcggaaaagagaacattgcatggctttttggccaatcgttatgatagtcgatttatcggttatttcgcttctttgttatcgatcatcggattcttgggtacctatggtatagagatcttggttgggataaagatcgctaatgtccttttccctaatgtctcctctatttatattatcttgggtttgagtctggtggtgtgtacgtatactgcactaggaggttttaaggctgttattgatacggaaaagatgcaattgtggttttcatacgtcgggattgctgccgtttttggattcttaatatctcataatgagaatgtattgagtcttgagacattggcttcggaccattggggattttcaaacttatcagtgttatttgtcctttcattaattgtggtgaatgtaccttggcagttgatcgatatgtccgtttggcaacgagtctgttccatgcgagatcaaaaggatataaagaaaggattgtcacaatctatttactcaattggaatctcttggtgtgtgttgatttcattgggtgttttactgaattattttccggactttacggctccttcgaataatgattacggttccttgctattgagttatctccaagaaccttgggcgtttgctctgtttgcggcgggctgctttgccgcattagtgtctacggcagatacattattgattgcttctatacagacttttgtttttgatatattgtatccttcacattcattgaagacgatagaagatacaaatgacccggagaaaatgaagggtttattgcgctatggaaggaaaatggtttatttattcggacttatcagccctttgttcatttacttggttagtattgtgataccgggtgttctggatttgttttttttagtttatagtgctcagatcatattgcttataccgatttgcgtggcgatattccgtaaggattgtgtacggatgagaaagtatgcgatattctctctttctgctggtttcttggcttctgtatgcatgatggtgtggatgctttttcatccggtggaatacgtttatctgtcggctccacttgtttcgattctggtttctgcgataccttggttttttattaagaaaggagagggttatgatactggagttaacaaaaggtgagattttcgaactaatggtttcagctttaggaggattcctattgttatgtaaatggatgaaatctacgaatatgcgaaaagtaagggaataccttgaaaaacagcccttagatgggctttcggattgcagttgtttgggggattttatgaagcggtcttcttgtaagaaactgtttaactattattttttatataggcttgtctccatttcttattatttgctgccggttgtttttttgttcttttttcttgttgatgcattttatttgtataactattttcttgttgatggatctgaagtattcgagaaagcttgtgttccgatgcagcaaagtgtattgatatttatttttgaatcagtggttgttatgttccctcttgttttaggagagtggattaaaagaaatacttatgagcctcttgtatgagcgacgattggagtcttgctatatagaacgaatatatccgtattcggaatcgaatgcttttttaggagtgagtatttgctctcgtttattttcagagaagactttggttgctctgtttgattggtgcaaggcaaatgtcaaatctgtttatgtattaatagccgatgagatacaaatgtacacttttatggcttctaaaggtttggaacgaaaagaggcttgtgcgaaagctttgcaaataggcgatataaagtatcgattcatagaaagggttatcaagaaaggtgactatgacaatgttcgattgctttcttggaaagcggtagccttagagcctcgattcaagactttattgcaaagacttagattattatatggaactgaaatcctttttcggcgggaagttatcaagcagattctagaacgtaacaggcggttgccggaaggttttcgttttgcaaggatcgactcttctgattatgatctagcttctctttatatactgaacgaactggcggttattttatatttccatttatattttgatccagcgtgccaatatcaaatctcacctttacctatgacccctttattggaaatcttgtatgacggtacttttttgaaagacttgcttgtccctaaaaaggatattggttatatagaaattatgggggagaaggatctcactggcagaatgattaaggttaatacaaaaggggcgcccttatagatagaaccgcccctccttatagttgtagataactcctttacttttttgtgagttcgttatagcttatgtataactttcattaactgctcgcccaagccaattgtatagccttgagagacaaatacgacacggttgaacgtatcggcgatcaagaagattggtaaggtattggcgttttgcaatttcatcgctgtagccatctccttttggatcgccccgtcgatatccagaccgtatgtgatcgtgctcggtaaatcgccgaactctttcggatcgaagttcttatagcccttctcgtcagggaagagaagcacgatgcctcgtccccaatcttctagttccttcttcacggcggcgatatcacgcatcgcatggtttgtcggttcttggcgggagcctagaagcgctacgatatagtagccacgtccggtagtagctagcaggctggtctcctcaccgttgtccgcacgtttgaacttattctcggagttgaaattaccgatcacctgtatctcgtccttgctttcacgcatttccaattggatcggggtggtcttgtccgcctccacattgaaaaactcgatctcggccaatacgctaccgtttgccatacgagtaccggtcactaacatataattaccttcatccatggataacggtttcttcagtaatccgctccaagtatctcccaagcccatatccacattaccgcctctctcgaaattcaaggtctgtaaagtaccgttcggcaaaaccttggcgatcgtgaagtgactgtaatatttcgggtcttgcagcgccttgattggttggtaagaagcgattaccttgccttgtttagcggtcgtctgtacggcagcctcgaaatcgacgtctacccaagcgttgtccttgaagtactggatcttgcgggctaccggctcgatacgtgccggaatacctaagctacgagccacggccacgaagaagatattacgggagcccttatcagcgatacgggatttccatacacccatcggcatgatcggaatacgttgtgcgtttagcgcgtcgttaatggagacgttattcttcacccaatccaccaatgcctgtggattctctacggcttgtttcgcaagggaaggctcaatgtttgcagcgaagaaactcttataaggagtcaggaactcattggccacacgaggattcatgatatattcattgaaccattcgctttgaaccgccggcgtattatttaaatgatccgcgaagacagacgctggtgtatcgcgtaaatccttggcggatacgacatccagtaaagccatcgcctgcgcacgtttctcggcgggagtctcccgtaagaacttctcgatctccatccagttaccacggctaccgatcatgaaatcctccgtcttcatcgggtcgatactcaactctttcgctaaagcctccgctttctcctccgtatagaaagtagctacgtatttattacggatcgcgtcttcctccaataaacgtttggcgttcgcctccttttgttccggtgtaacctcggcggggatagagccgtctaccggcggcacgatatccagggcgatcgtctccacgtctcccggtttcttgttcaaggcgatcgtaacctctccgtccttgccgaaagagaccttgctgtagccgaacttaccgtccttgctggcccataccaacatatccccttttccggcggataacgagcatttaccatccgcgtccgtcttcttgcgggctacgctgttaaactcggcgtagttataaatcttgaattcaaccaaagcgtctttcactggtttgccattggcatccgtaaccgtgataacggctttagccgaaggtgcgtaattatcgatcacgttgatctcggtgtaaccatcggtacgttccatgacatcctccgggccattgtatttaccgaatactttcgtatgcatcaacataccccggtaagcagggccgttgaaccaacccagattcaataccggttccggttcgcaagctcccaagaaataccatttaccgttcacccaagcctctacccaagcgtggttatcgtccgtgtgcgcccagcgaggcgtatatacctgacgggcgggaatacctacggagcgcaaggcggctaccgtgaaggtggactcctcaccgcaacgtccgtaagcggtcttcacggatgctaaaggggaacttgtgcggccatcggaaggagtatagataaccttctcatggcaccagtgattcacttccagtacggcgtcgtacaaagacaagcctttcacccgatctttcaactcatcgaagaaaaccatgcggctctcatccagattctcgttattgacccgtaccggcaatacgaaatgccggaagatatcctcgggaatactgtcaccccaaggcatctcgttacgtgcctggaaagaggagcggatgtttttcagatagaaatcgccgctatagtccgtgatgtccccgatcggcatataggcgtacataaaggtcaacgcctccctctcttcgggggtcatctggtcgttaaataccgcgaaaaggtttccgttaggcagggcggcctgtttcgcttggaaatcgttctcaacctcggcccggtaagcggcgtcggtaatgaaatgttgttggttgttacagcccgtccatacgagtactgtaagcaacagtgcgaatagatgttttttgttcataaagcggatatgtatgtttgccaaaagtaatgattctatgcgagatagaaaaattctcgaacaatttgtaagaaagatttgtttttctatagaaagaataaatctagtcttcctgtaaattagggaccggatttcttctttttatgtgattataattgcaaaaagtttacgaactttgtgacaaagtatcaaatcactaatcataaaacccgttatcgcgtatgtttcaaaatcctgagcaagtgctattaatagcctctgtgatcctgtttttaagtatattcgccggtaaggccggctatcgtttcggtttacccgccttgctgttatttcttggcgttggaatgttgttcggcagtgatggtctgggcatccagttcagcgatccgaacgcggcccagtttatcggtatgttggcgttgagtattatcttgttctcgggtggtatggacacgaaggtggcggaggttaagcccatcgcctcgcaaggcgtggtattggctacgctcggggtgcttgctacgacttttatcacgggtgggtttatctattggttatttggtttgttcggtcaatatgttacgttgactttcccggagtccttgctgctggctgcggttatgtcttctacggactcggcctcggtattctctatcttgcgtagcaaaggggtttacttgaaagagcgccttcgtcccaccttggagttggagagtggtagtaatgacccgatggcttatatgcttaccttgcttttgatcgcttatatacaaagtggggggatgaatatctgggaggccggattatctttggtcattcagttatcggtgggtgccatcgccggttacttgttgggaaggttggctgtgtttatcatcaataagatcgatatagataatgagtctttgtatccgatccttttgttggctacggctttcttcaccttcgccgctacgaccttatgcaagggcaatggttatttagccgtatatatcgccggtttggtggtgggtaacgccaagattgttcacaagaaaagcatggggacgttctttgacggtttcgcttggttgtggcagatcgtgatgttccttacgctaggcttgctcgtaaatccgcatgagttattaccggtgactggcgtaggcgtgatggtgggtgtctttatgatcttgttcgcccgtccgattagcgtgtttctctgtttgataccttataagaatttctctttcaaaggtaaactatatatctcatgggtgggattacgcggggcggttcctatcattttcgccacctacccgatgatcgccgggatcgagcatgccggtatgttcttcaatatcgtattctttatcacgattctttctttgctgattcaaggaaccacggttacccaagccgctaaatggctggatatggtggatgagccggaacgtaaggatgagttcggcatcgactttcccgaggatatcaagagtgccatgagcgagatcgatattaccccggcggtattatcccatggaaataagttgatgcagcttactttacccgatcataccttggcggtaatggtaaaacgggaaggccgctatttcatcccgaaaggaaacacggaattaaaggagaacgacaagctgcttatgatttccgataatgatgaggcgcttttgcaagcctacgactccttgggcgtaaaagattatacgatgaagaagaattaaaaataatgtgccaatgaagataatatgccaatgtgccaatatgccaatacgaatacttttcgtgtagaataagcattggcatattggcacattatccacattggcacattattttaccggatagggaattccgttatgcgtagagtcgtgcatccgtaagggatcaactcgatatcctcttcttcgcccattggctcattggcttgcatgaagaaatttacaggtcccgccgagcctttgaacattttccatgaaggtaagattcgtccttttgtcttgatcgtgataggagcattttccagattccacgggtaagaggcgatttcctctgtctttttaatgaagaaatgtttctctagttctcctttttccaagtgtttgcgaattaggcaataattccaaggggaagtagaggttacctcataataccattctcctttatgtgaagactctggacgctgatcaatcctacgttcccatttctcatccatttttagggaatacagtagcgggcctcgttcaatgacagccgcatcatcataccaattgcttgtggttatgtgcattggtaattgtaactggatattatcgccatctttccattcccgattgattcgtactatttcacctgaatgagctgcgactgttgttacttctccatttatcataactactggattcttacaccaagcgggaatgcgcaagtggaaagggaaaaaagctttcttatttttttcactggggaacgataaacagaaattgatcttttcctcaaaaggataatttgtcttttcagagattttgaccgtaatgttgtttccaacttgagcagtcacttccgatggtgcgtagataagtgaagcgatgccattgtcggcggtggcgaaccataaatgtcgtgtaaatttaggccagccttgatgtaagttggaggtacaacaaggataaccacttaattctccgaaaacaatgtcagtatcctcgtgtggtgagacaaagttacgtccttcgcaagagattgctatttggttgacctgttgataatattgtcgtgcggaaaagtcatccttgatctgcgttggcagtacattgtatgcgactttctctaaatgatctgcccactggacatcaccggttatctccaacattttttcgagagagaacatcatctcgacagcggtacagagttctgaaccttgtgtcgggtttccgaaacgtaaaagttcatctcccgcccataatcctgtaggaaaaccaattgtatggcgcattttccgtacagcttccttaaccgcttccagattttgaggattatggctctgttggtaataaatgacaggttccttgaatccttgggcgagatttacgcaatgtaggctgttctgtctggctaaatgatcttggtttaagaacacgtcggtccaattgaaggtttgcttatggattaactctcctaactccaaaaggaaaggatcacctgtgatattataaagccaatatacgaccatcagattatcccctcctcgttgttcagcccagaaagtccattttcccagaggacttttaggcagttctgaaagctggtatttgaaatagctagtgaggaacgagatgactctttgatcgttggtagcggaataatattgttgcagaactttgagcataaccattttgggccaccaatcttgtgcgttatcccgttgtaagccgggttcatagtctctatctgtatctggcccgaaatatccgttaggcttttgagaggccaatgtccattcaacccaaggctttactttttggatcaaggcctcatcattcatgatgtaagccaaaggtagtaagccatctatccagtatgggcctcgttcccatacgtctccatctccgcctaaccaaccgttacgcggtcccattactttcgtatagatagaatccagatggccggtcattcccgtacacattcgttccatttggatttttagccaacccgcaggtttaacatccccaataggcaactctatataaggcttagaggctaatggatagcgattgtttgggtaattaatgttgatagaaccttcatttcccggcaaagtggcagaaaaggaggtaattgagattaggcttgataatgttatcgttaataaatacttcattttgatgcttttttagttattcgttataggggatccataccctcatttttcctgctttacggttatcccacgcgtaatagggaatgaaggtagcagattgtgccctaccgtttgttttaattgtttttatcccattcaatatatcggaaacgaaggctgtctggaatgttgtacttgggctcaactggatttgatcgaaatattccgggttgtctatttcttccatgcagtatacaagtggccctcgttgaatcgcccgtttgccgatattttccttgacatgcggatctgccgcgacaatttccacgggcatatccatatctagagcgattacatcttgcgatttccaatccttgattaccgcatagcctttttccttaggcacctttattttcttgccattgatacttaaatcataggttttgcaccaatcaggaatacggaggcgtatctctttctccaaaggctgagaagtggaaattgttagttttaccaatccatcccacggatagttcgtttcttgttttaataggatatccgtctctcctatacgtatttgccccgtatttccgatgtatagatttacccataacgcatcattggaggaggcgtagatataatttccgatagaaggcaagaagcgtgaaagttgacttgggcaacaagcgcaaccataccattcttgtctatggtgatcacccttagattccagcgggttgacatagaagaagcggtctccacccaaggagataccggcaagcgcaccgttatataaagaacgttccagtacgtcgatgtatttagagtctccggtaagttggttcatacgttggttccaaagcaccattccgacagaagcgcaagtctcgcaataagcatctaggttcggtaaatcgtaatcctccgtaaacccttcgttatcccgggatgaaccgattcccccggtgatatacatattgcggtgtaccacatcatcccatagacgatctatggtagctatatatcccgtatcattcttcaaggcagccacatcggccataccgcaatacaaatacatacatcgtaccgcatgcccggagatatcggtaagttgccggacgggaacgatatcttgatagtaaaccgggtcccatttaccttcatcacccatagtgccgtgaccgtgtccacgttcctccagcagccaataagcgaaatccagatatttctgctcttgggtggtttgataaagcttgacaagcgccagttctatttcctcatgtcccggtacccaatgtttttttcccggaccgaattggctcatcatatgatctgtcatgcggatacatacgtctaataacttgcgctttccagtagcttgataatacgccactccagcctcaatcatatgtccggcacagtacatctcatgcttgtccatattggtccaccgtttatccaatccggtgagtgtatagaaggtattgatgtagccatccggttgttgggcggcagcgaatttatcaatccattcgtccgccttcttctccagctcgggatccggattgttgattaggctataagccataccttctaacgctttatatacatcggaatcatcaaagaaaatgccggaatgctctccttcccctttcgctgcattctcgaaattacggatacgtccggtttgattctctatttgatcgatacagacaggcaaggtcgccgagacatgtttgctgagtctgggtgaccaaaagttgtcattgattttcacatgagagaaatcgatctgctcgatcatcttcaaaggctgttcctttatatcttctttagaggtctggcacccttgcaaaagaaaggcagacgcagcgagtaaaaggtattgcttcatatagctttagaaattgagattaaaggagggtatgtcaatatagagacataccctctatgttattattgataattcggattttgttccagattcggattggtatctactactttttgaggtaagggaaataccgttttataatctccattcggctcatgagataaccatttagcttttgtgaaatgaccgaaacgtatcatatctctccggcgataagattctccagcgaattcccaacctagttcatcatagaaacgtccgaatttttccggataaacttgattttgcgaagttaatacatagttttctaccgtaccgtatttgtaacaggatttttcttgtaattgcgctcctgagacaattgctttttcaggatgttctttaaaagctctttttctgaccatacttacaatagacgctgcttgatctgctttcccagtacgtaaaaggcattctgctttcatcatatggacttgcgtaagtctgaataagaccaaatcattattgagctcacttctagctcccatctcgacttcatattttaaccaacgatatccttccgcttcaccggtgaaaataccgttaggcattttattgacgaagataagcggttgtcccattaagtcataagagcctgtgagaggtgtcccatcagatgcgtattggggacctcctagccaagtcgcatttaaacgttcgtcatctggatcataggtgtcgatgaattgaggtattcctttataggccccagctccccaagggcttccaactagatcatacgttttttggtttgctccgtgtaaggcggctaaatgatagttaaatccagtggcaaatatttcatcataaggaatgactaatatattttctaatgagttttcattgtgtgccttaaatggatcgttataattaatgtctaaactgtattttcctgaattaatgatatcatcacactcttgaatacaagcattccattggggatcacctgtatatacttctgcgttcaaatatacgttagcgaggagggctttagctccccataatgtgaatcttccataattagattcatttttctctgttgggagatcgctgaaagactctttcagttctttgactataaaatcataaagatccttccgggatgtttttataggtaattccgaggtgggttccgtgactaaaggagcatctccaaaattatctatgatgtaccagtaatagaaagcacgtaatgctcgagattcagcgatcatggtagccttgttttcattagcggcaaaaggaaaatcatcttggttgataatgctgatagcccggtttgccaagataattccggaatagcaaacttcccataaacgattcacttgtaattgttcggagttccatgaatgttgatgcattctacgaaatacacctccatcatcccaaccggaaccattagcggggaacactgcggcatcggtacatatttcttgactcagcattggagcttgtccggaaccgcaatacccccaatcttgaagattggtataagcggcaccaaccactttagttgcgtctcctgcttcatatttataactatcttcagtaatgtcagagaagatttcttcggttaggtctgtgcaggaaataaagttcaatgaacagcaacctaataataagatgtttatatgttttttaattgtattcatgagtttatttattttaaaaagtaaacattgcgcctaaagtaaaggaacgtgtagaagggtaacggcctaattcatcacacccgggattaagtccttgcgtattaacctcagggtctaatccactgtatcctgtaaatgtgaataggttattaccagttgcgtatatacgtattctttttaagtaatcattcttaagttttaaggtataaccaatggtaatattatcaattttccaaaagtttcctctttcgatgaaatagctaacatattgaagctcctgttggtcgtttagtacagtctttccgtacttcggttcataagctgtggcaagcaaatttccccgggtcaagtttacaggacattcataaaacatgcggggatagttgagaatgtcatagtcgaacgcacctcgcatagttatacctaagtcgaaatttttgaaggtaaaactgttatcccagcttaataggtgtttgggcagaccatttccaataatttttttatcttctgcttgttgctctgagatcggttttggattaccgtttttatcttcaataatccaacgtccttcactatctatatcaatggttttaaaaccgtagaagttaccaacctcacctccctcaaatattcgatgggtatattgttgaattggttcaccagtccaaccgtcttctatatagccggattttaattggaattcctcgtttgataaggcaaccaacttatttttattggtagaataattaaaactagttgtccatgagaattcttttgtttgtaccgggatcgcactgaggtgtatctctagtcctttattttgcatagtccctgcgtttgcgaggatttcctgatataaataagggggggtggctacttgatagttccatagcatatcttttgttgtacgtttataaaggtctatagttccactaatacggttatcaagaacaccaaagtctactcctaaattccattcttctttcttttcccaacgtaggttcggatttgcgttacttgaaggctttaatgaaggaagccaaccagaaccagtataaagattcttatcgctagttaagcggcttaatgacatatatggatcttcagggatagagcctgttacaccaaaacctaaacgagcttttaagctactgataaaatgtaatgaactcatgaaatcttcattatgtatattccaacctacagatacggctggaaaatttccccatttataatttgctccgaattgtgtggctccttcatgacggatactgacagatgctaaataacgatcattgaagctataattgacacgagcaaatacaccgattaacttagacttggttttttcagacttttcctcaacttctcctcttttcaaagctgctccagctcccatattattataactatattgatccgatggaaaatcccaattttgcatccagtaattttcataggtattgtcttgataagaataacccgctaaaccagtaaggttatgagctccaaaattatttttgtattgggctgtgatctctaacagattatcgatagaagctgttgttcctcgagaagcaaacccatttttcccattgcggactgtagatatgtgttttttagtttcagcatatccgcgggtttgattataggaggttctcgacactaatgcctttacgaaaaattcatccaagggagtcaatgtgacggttccaaatgtacgtaattgggtacttttattctcgccattgctttcatacagtgcggctaccggattcatatatccgttcattgtcggatgctcaatccagtttccgttatcatctttcggacgttctgttggaatattgattaacgcatttcggtaaatctccccattgaagcttttgccatctcctaaggctgtatatttttgttctttacccatgatgtttaaattaaacttcaataaattatcccacatagaatgattgatttccaatctggtggttaatattctattgtctgatcgtttgataataccttgaccggatttgtagtttatattcgctatgtaattagagttgcgattacctccgcgtagactagcgttagtcacatacgaaataggtgtccttaatatctggtctagccaatctgtatcgtaaccataatcaatagcaccgggttttccttgttttactaattgacgatattgattggcatccatcatatctaatctttttttgatttgctgggtagtgatataggcttgaatatcgatagttacaggtatttctcctttcactttttttgtggtgatgaaaataacaccattatttcctctggttccataaatggcggcggctgagccgtcttttataacatctatgctttcgatatcttctggtgcaacagtgctcatatcacccggaactccatcgacaataactaatggcacccggtctccttttagtgagccgataccacgcaatacaatttgggatgaagacgtcggatcaccatttggcatgacaatgccaagtcccgcaacctttccttgaagcaactgggctgcgtcttgcactgaaccttgaatgaatgtttcactttttatgctggaaatagatgaagttaattccccttttttctgtgtaccgtagccaaccactaccacctcgtctaattgttgcgtatcttctactaaacgaatattgatttgttgttttccatttatgggaacatcttgtgtcaaatatccgatataggaaatctgcaagatggcagaaacaggaacatctaacgtataattaccatctatatctgtaatagttccgttagttgttccttttataacgacgttagcaccgataataggttctccggatttatctgtaattgttcctgagaccttattgttatcctgttgttgttctgctttttcatctttcttcatcaacatgatattactgccttcaatcgcatatccaatattcgtgtttctgaaaatttgtgacaaaacatccattaccgtttggtcttgagcgtgtacggatgctttacggtttaagtcgatttcatttgtattataaatgaataaataatcagtttgctgttctatctgttctaaaattgaatgcgtagattcattattagcattgatattgatgcgcatcgtttgtgaatgtacggatgcgagtaagctgaaactgaatacaaataatgcaatgaatgttaatctcattattcgaaatgttttgtcttctgtgttaaaaggggacataaaatgcccgttacaaatttttttcatacatttgtaatgtcttatttgttagtactaaatgaatttattttcgcaagtctggtactgacttacggaagggggatgttgcagcatctccctttttgtgtaatttgtgctgttaattgtttgttatgttttcattctctatattctgtatttaaaaggttaacgactaaatatttattttatcacgattagattcgtctcttcattttttgtataagtgaatttatgttttaattgtaatactttcaatacatggtcaattccgtctttgatacggaatttgccggaataacggtattgaagtaaggatggtcgttgaacatcaattttaatatcataataaagctgtaacttttctattaaactttggatcgactcgtcttcgaaacagaataatccctctttccatttaaagtagttgtagtcaggaatatgggatgtatttaatccttcctgacttgcgatcgccatctcgttcggctttaggcgtaatcttttcggcatagttaaggaagatatttctacgctgccatttaataatgctgtctcaaataaaggactgttgtgatatgccttaacattaaattcggtacccaatacatgaattgcgtatttttcggtttgtacggtaaaaggacgttttttgtcatgatgtacagaaaaatacccttctccgttaagttctacgttccgtttatttgtgccgaatttattaggaaatttcaatgtcgagcgagagttgagccaaacatgtgtcccgtccgctaaagttaactcagctcgctgacctgtgggtacatggatggtttgtatttgtatatcctctaccttttgttctacgaattgtttagtaacaaagattccaattaaaaagatcgctgctatttttagtgtttcgattgcgatacgtcgaattgttggaatgaattttttatgaagtgttttttgctctgtatccgtatgccaaagtgaaatatcatataatttacgtaaagccagaaattcacgcatgttatcaggactttcgtccagccatgacactactttcagtctctcttcttcggaaaccttacctcttatgtaccgttgtagtaattgctccatgaatgtctgttaatttattttctattataaaaacaacgctgtgcgctaaatccctagtggaaaaatgaaaaaaattaagaaaaaagaaaataaaataagggtagatagtctttcaagttgatacgcaaagcttttaaagccttggttatgtggtattctacaccttttatggtgaggtttgtctcatccgctatttcttttacggttttattctcgaagcggctcatctcgaatattcgatgagtttgttctggtaagttttttaaagttttgtggatgatcctattgacctcatcagagaagatctctttcggatcgcaagcctcgagtgtggaaattctaatgcttagttctctattttttatttcctctaaattttcaatagcggcatcatgtatggctttatggcgtaaatagttaagggctttatttttcaaaatcgtgagcaataaggcttctgttatctcgttttctccagcagagaccagtcgccaatattttacaagcgattcagctacgatatcctcagccaccatgtcatcatgtacatatgatttggtgaacaggaatgaccgtcggtaattccgttcataaatgatattaaaatcgtctcctttcatcttcaatacagatttagcggtaaaagtaggaatttttgatagaaaaatagttaaagtaatcatactttcattttccccgctttccggttatctcaagtataatatgggatgaaagaaattgattgttatccatttatcgcattgatagtaaaaggttagagtggaaagaggtcttgaatacggaattcagactaagttctatttactcaaaatagttggggttatctgttttaattttagatcattatgaggcggtgtctatatgtggagacggggcatgccccgtctctctctaaatccgttgttccttaccattcacgataaatcgcttgataggttgttttaccggtcttaataggtaactccaatccttttcagttgtatctaacgtgatttccaatccatcttccagttgttttactttataattaatcttattatttccaacaggaagatctttcatttcaataaagtcccaatctgatggtaaattaggacttagggtcaaggtctttttataggcttctggttgtatgccatatatataacgaatcaaaggtgttgctataccatagatggtccatgcttgaacagggcagccataatcaggcatcatctcattaattgatcccggaagtgtacggccaaatgtatcgacgatgcgattgatataccataaagcctcatctacacgtccgtaagcgcattcggccatcgcttgtacgcctgttgcgatagtcatcatgcgatctctttcgactgcggataaataaggaccatattcgccgcaatgctcttttcgtactttatccaattgccgaatagctctgtcttctgaggcaatatgagtttctattggagtgcttattacccaattcttgttagttaaccatcctttcataataccagttggatacgcttcaaattgtttatacatatcctcatacattgcgatatgctttttcttgctatcctcatattcctgtaaggaaacctcggcaacatcccacctgtattctgtattacgaacctgttcgatagcacctttagtcgtttctaaggcttgctctctcgttccataaaaatcacaataaatttctaaatccttatcccaaaataggtcgtttatcctttctttcaaatcgattgcttgcgaggcgcactcactggcaaatgcttcttctcccattattaaggcaatctgcgacataacttccagtgcttgctgggtataaacagagacatcaatcaattccgcatttaatcctctaacttccatgattccatacccttcggggaacatattcttatttgtatccatatctttcaaaaggaagttcagacctttttgcatataaggatacatatctgcaaggaatttgttatcaccagtccatttataaacattccatacagcgatgacaaaatgagcagtctcttgagtatttcctttgtggctgacgaatgcgttgaatgccatttcatgcaaaatacggccattcctattggctttctctgacatctctttgataactctcaatgtctcttttgctaatttttggtcacctgtagcgacaaggccttgtaatgaataagaattatcacaaccgaataaccatggatattcaattgcgcccgctcccagaaagcgtcctgcactttccatatctgccgcaagccattccgtattgattttgcaccagttataaacctcttgtaactttttatctggaatgttaatccgtcctctctctaatagttgggtgtaatacatttttttatcttccaacatttcggaatggttcgctaagatgtctttgtaactttttagggcatcctcctcactgtcttttgatcctgcgatgacgaaagaaagttttttctcctgattcttaggaagtgtaatcgtataagtagaagaggcacttttacccgttccttgcgtatttatataagtaggagtatctagttgataaatactcgtatgttgatccgctccccaaatcacgttccagttattacctaaatctttcgctttaaaaatggcatcttgggcatcccagttcacgacatcatttgcgtcttttaacccgattgtcccggatgaccatacaggcaacaaatctgtttttgcgacaaaatcaaaaaggactgtttgctctgaatccgatacattttcgatggtataggtaataacaacaccattttctccttgtgggcaaaattggaaacgattgacacggatactattattaaataaaggagcgtactcaaatttacttccaaaaggataattcgtatattgtattgcgttttccaaccaacaagaattacctttattatctgtcatttttacccaaaagccatctaatagcttgatcaaatgattccaaactcctcccatctctccgggagtatgtccaccaagatcagggaagtttccatcttgcgtacctattatgtaggttttatctcctgctgtcagataaggatttttttcttgacccgcttgattcgagattccttccatgattgtttgtatctcctcatcttgagtgatactttcatttgtttgacaagatataaatccccccagtaaacaaatgcatagataaagtgactttagatattgtgtcatattcaaatcttttgtggataaaagtggaggggatattatgataccccctcacacttactataattaatatcccggattctgtgtcaacgtcggtttaccatcgacatagcttctatctatttcagttagaggaatagcgtaatagcgatggttcttatcaaaaacggctccatttaaatattggatatgtcttttttctctttcgatatatttatttaaaaaatcctcagcgatatcccaacgtaccaaatcgaagaagaaatgaccttctaacgcaagttccaagcgttcttcaaatcgtacacgttttcgtaatacatctttacttagtcctgcccatgaatccttatagatatccactttataattggcggcagctggaccattgccaaaaggtgcttcatctcctaatctcacgtaagatccgtcttttgccctttgacgaatcatattgacatattcttttgctttctcagggttaccaacctctacctcacattccgcagcccacaataatacttgggcgtatcgaataatattgaaattcattgcgttaaattttgctgtattgtcataagcgtatgtagcaagttggttttctaatataatccattttttttggttataaggacctgcgctgacttgatccctgatccaagcttttcccgggtgcaatccccaatcatgatatggaacgcctctacgaccaacgacccagtctaatctcggatctacaggggtttccatatccggttcccatgcctcgctagattcgatatcttggtcgtttttgaattcatggtcagcgtaagtgtcaatcatgggtaggccattttcgtctacttgataggcatttactaagtcgaaagtaggttgttggaatccggctccacttaagtttggttgatctggagcattgggataagataagtcgaaaccacgttggctacgatcgtaaccagctcccgctacatttaccgctacctggttagaccataccacttctgcgttattgttttgctccgcattgaagttatcaaaataattgtcaagtaacttatattttccgctagtgatgacttcgtctaataaaacttttgcttcgctatatttttgctggaataaataagccttggccaagaacgctttagcggcgtttttcgtaggtcttccaggctcactctgattatccggtaaaattccggtagcaaaagagaagtcttcttcaatattaggccaaatatctttgtcattgggaacccttctttgcggatcttctacgtattcatcaatataagggaccatgttccagatttttttcgcttcaaaatgataatatcctcttaggaaacgggcttctgctctaatttccatttcactttcttctgataagccatcaattttattatcattcagcatacgaagtacgtcgttgcaacgctcaatagctccatataccagtatccatttatcccggatacgaccattttcagcagtagcgacataacgctccatctgtagcagttcgccttgatcgccggtagtacttcctttatggatatttccagcgcacatatctccatagaagacattatccggcccacttgttattccccaaactccgttgataaatccgtttaatggactatagcaggcaataaggagtttattcacggtactttcatctgttaatacagactcattcaatttgcctaatggttgtttatccaaaaaatcagaacaaccattaaacaggctaacagccatcgtgacggttacccatgtgaacgtttttttcgctatatgaaatagatttttcatgtttgtttaattttaagtattagaatgataaattgaaaccaatggagaatacgcgtgctagtggcatattattcatataatcgacacccatattcttgtcatcgccgttcttaacctcgggatcaatgttgttatactttgtcaatgtcaataagttttccgcattcaaataaacacgacattgctggagtccaattttcgaaagcgtttgttttggaagggtatatcctaattctaattgtttcaaacgaatataagaaccatcttcaattaagtatgaagaaaccttacctgcctcatcatttggattcaagatattgatctccggcagttccgcatttctgttttcaggagtccaagtattcaatatacgggtacttttattgaaataatctccccagaaatcaaggccatccctaccgcctttcgatgcgaaacaaatatcatttccttgactgccttggatataaagagacaaatcgaagttcttgtaatagaagcgtgaactcaaagagtactcgaaatcagggtgaggattaccgatataggccctatcttggctgtctatttttccgtcattattcacatctctatatttccaacggccgattgctttgtctgactgttctacatgcgagtcgacctcgccttgtgtttggaaaataccatcgatcacatagccatagaaagaggaaatcggatgacctacttctgttcttgtatatgtgttcgatatgaattgatttgaagctaatttctttacctcattacgatatccggacaaaatgagccctaattcgtaccggaaaccatagtctgtcgtattctggaaattgatattcaattcatatccgttattttgcatttcaccgatattcataaatggggcacttgccactcctccggtagaaggataagtaattctttgcaagatgtcggtagtatatttatggtagaaatcgaatgacaaattcagtttattattaaaaagacctgcgtcgataccaatgtttgtttgtgtagtcgtctcccatttaagatccggattaccaatgctctccttactgataccttgagtgacagagtttggatctcccgctataggatagctgctagttgagatattcgtataatacatggacgcaaatgcgtagttatcgatatcctgatttcctgtcaaaccgtaactggctctgattttcaaatcactaagaatatcttgccctttcatgaagttttcttccgtaagtctccatgcggcgtttacccctgggaagtagccatatctatgattcgcaccaaaacgtgaggacccatctcgacgaataatagcccctaaataatatttgtctttatattgataattgacacgtgcgaacagagagaacaaagcgtattcatttgcgttgcctgtattgtccttgttggattcgccagcgtcaaggtatctataatcgggatcctcgataataaaattacttctataagcagagagattctctattttagaactaatggcttctgtacctagcaaaacattcagattatgtgtttcacgaaattttttcgtgaaggtcaaagtattgttccaaaccaattctgatttacggcctcttgcttcctttaaagaattcactagcgtatttgcgtctcctttgttccaataagtttttggattgaactctttggagccgctatcctcaacgtttacgccgacatttgtcttgaattggaagtatttcaagaaattgatatccaaatacaaattacctaacaagttgaggttgtcattgtaattctctctttgattataaagttgggctaccggattcttggaatcacctaaaccattagcttttgttccggcccaattaccttctacgtcgtaaaccggaataagcggagccatacgtacggcctcatggtctgatttgcttcctttgtatttagagtaagttgcgcttaggtttgatcctaatgtggcgaagctcaaaatcttaaattgagaattggctcgtaaagagaagcgatcatagcccgcccattttacaagagcttcttgtttataatagtttgcgctcaagaaatatttagacccattgccacctccttgtgcgctgatatcaatgtttgtagtcggtgcggggcgataaacttcatcagcccaattagttccgatcttattagcgcgcataaattgattttccgcagtattataagtgctgagatctacctggccttccatggctcctgccggtagaatataatcaggaatgacgggtgtagctccgttgccatattggtcatgctgtggtgttaacccggcgtttctcattgcgttccacaagacttctccatattgttgggagtttagcatttccggcaagttggtgggaagttgcacgcctacgtttacttttacgtcaacggtaggttttccttctttaccttgctttgtcgtgattaagataaccccgttagctgcttgggaaccatagatagaggcggaggaagcatccttcaatacttgtacagactctatacttgaaggatttatttgggatgcgatctcgctttttgtaggaaaaccatcaatgacatacaacgggctgttattattcagtgttccgacacctcgaatacggatagcaggagcatcgccagctacgccggaagttgttacggacacaccggataacctaccttgaagaaggttctgtatattcccggatgattgaatagataaatccttcgtagatatggaagagatagatccggctacgtctttcttgcgttgcgtaccataaccgataacaacgacatcatccaatgcttgtgcgtcatccttcatggtaatttggatgttcgtctgccctttggtcgggatttcttgtgtctgatatccgatataggaaatttgcaagatggcgttctcggagaccataaggctgaaatttccgttaatgtcggtgattataccgtttgtggttcccttctccacgatatttgctccaatgataggttcaccaattgcgtctttcacaacaccggtaattctccggttactctgttgtgtaacagaagtgttttttcgcattaacatgatgttattaccctccatcgcatatgagatgtctgtttgggtaaagacagatgataacacatctgctacggttttattttgcgcctctacggaaaccttacgatttagatctatttctttggtgtcgtacacaaagagatagtctgtttgtttttcgatttcgtttaagacaatttgagtgtttgcattgttcacatggatattgacccgtgtattttgcgaattaacagatgcaaacattcctgtggttgatagaaatagtgttataaaagttaacttcataactctttttgtttgatttttcatacatttgtaactcttgaatttgatactgatgatttaagtgcatgtggtattgattctttccggggagtgttgccgcatttcccggtttttatataccgtttcttttttgatattttttatctcataggcatacatgatttataaggttaacattctgttcttactttatgattattagattcttatcgtcatctttgatgtatgtgaatttatgttttaactgaagtacttttaatacatgctctattccatcttgaatacgaaatttgccggaatagtgatgtttcaacaatgagggacgttggatctcaatcgtagtatcataataaagttctagtttctttattatatcttggattgattcattctcaaaacagaacaggccttctttccatttaaaatagtcgctattattaattgtagatttcttgagcatcctattctctatactaacgatttcattaggcttgagttgtaatccatttcttaaattaggggaactgatttttacactaccctttaaaagggcggtttcgaacaaggatgtgttatggtaagcttttacattgaactctgtacctaatacttgaacatcatgattttgggtatgtacggtaaatggactattttcattgtgctggacagagaagtaaccttcgccgtctaattccacgtttcgggtgtttgcgctgaattgttcaggaaattttagggttgagcgagagtttagccatacatgcgtaccatcggctaaggtgacctctgcccgttgtccggcagggacatgaatggtttgcatttgtttcttgttcgattgttgtatctgcagttgtttgcttccccaaaagccgattagaaagatggctgcgatttttaagatctcggccattatcttccgtatggaataatgtactttctttacggaatttgtcttatctgtattggcttgccaaagtgaaatgtcatataatttgcgtaaaaccagaaattcacgcatgttttcagggctttcgtctaaccatgatgctattttcagtctttctttctctgaaacctctccttttatgtatcgttgtagtaattccttcatggtatctattaatttcgctttataaataataaacgatgctgcaagatagatccctagtggaaaaacgagaaaagtcaagaaaaaagaaaatagaataagggaagataatcttttagattgatacgtaatacttttaaagtcttggtaatgtggtattctactccttttacggtgaggttggtttctatagcgatttctttcactgttttgttttcgaaacgactcatctcgaatatcctgcgagtttgttcgggcaatgattgtagggtgcgctgaaggattgtgcgtatctcttcccggaaaatttcttctggatcgcaagcctctaaagtggatatgcggatgcttagttctcgcttttttatttcttctagattttcgatcgcagcatcatgtacagctttatggcgtaagtagtcgagagctttatttctcaagatcgaaagtaaaagagcttctgttgcttctcctttttgggtggagattagtctccaatacttcacaagagaatcggatacgatatcttctgctatcatatcatcatgtacgtatgatttagcgaacatgaacgatcgttgatagtttcgttcgtaaataatgttaaaattgtcttttgccattataagctgagtaataaaaataagattacatgacttctggagtaaaactaagttcttcaaagttccctaggaactatattcggtatttacaaactacgcttcttcctaattcacatattgtatctacagagcgtaaatagactaaccggtgggacttttatgccctgaaatcatatagttatgtcaataaaatataagacaatattgatttagaatagaaaagattgtgttttgctaaaagaaatcaatatatttgccttatcttttggagttttaacataaaaggcatttggcactaaatagtcatgaacatagttcctagggaactattttcttcattcctacagaagacaaaagtttcgtgccgaagaaaccttagtttccctatatagaaacaaaagtttcctaagcggaaaacaaaggttttagcggtataaaactttagtttttcatggataaaaactgtataagcttatatgttaatgttttgtctgtataaggaagagaccgtatgatgattgcggcaagtgtggagagatcgttctgtttagagatagaaaagtagtaaatgatggtagatagggcctgataattgtagatgttttttatctaccaccataggctaaaccgtctaaagatagatgattacaaggatagttgtagatgttgtagataaattggatatttttgaaccttagtcagtaagagagagtactgttcgtgagttgatgaaggagatctcctcattggctattcgcttatctggatttgggaaaattacgagatcaaatacgaaacatcccgtttctttcgttgttatatggaggattatccatatatttgtaaataaactaggtaagcttatggcagcgaagaaagatagagtactttgggctgatgacgagattgatttgttgaaaccgcatatcttgttcttgcaggacaaagggtatgaggtcgttccggtggtgagcgggcaagacgctattgactgctgtaaggaacaatcgtttgacattatttttctcgatgagaatatgcccggcttgacaggattggagacgctgtcgcatatcaaggagatcgctccgaatgtgccggtcgtgatggtgactaaaagtgaggaggaaagtatcatgaatcaggcgatcggaaataagatcgcggattatttgatcaaaccggtaaatcccaaccaattgcttctctctatcaagaagaatgtccataagaacgtgattatctccgagacgaccacggtgggttatcagcaggaattcggtcgtataggtatgcaaatcaatgattccttgaccacagacgactggatggaggtctataagaaactagtgtactgggaattggaactggaaagcagccaagtggcaatgacagatatgctccgtatgcagaaggaagaggccaataacgcttttgccaaattcgtgaagaagaattatgtggactggatacagaatccggtcgatcgcccgttgatgagccccgacctgttcaagaagaaagtcttcccaatgttggataatgacgagaaggttttctttatattgatcgataatttccggctggatcaatggcgggtggtaaaagaattgcttactgagtattttacgtttgacgagagcttgtattatagcatactgccaaccgccacgcaatatgcccgcaactccatattctcgggcttgatgccctcgcaaatagagcagatgtttccggatttgtgggtggatgaggagagcgaggaaggtaagaatttgaatgaggctccactgattcaaacccagatcgatcggttccgtaaaaaatataccttctcatataataaagtacacgattctcaatatggcgagaaattgttgggtacgatcccttctcttactcgtaatcaattgaatgtgattgtgctaaacttcgtggatatgctttcgcatgctcgtacggagagtaagatgatccgtgagttggcgcaaagcgaggcggcctatcgcagcttgactaaatcatggttccagcactcttctacgcttgagttgttcaaacgaatcgctgagcggggagctaaggtaatcgttacgaccgatcatggaacgatccgggtaacgaatccgatcaaggtgataggcgataagaacacgaataccaatctacgctataaggtaggcaagaacttgaactacaatccaaaagaggtattcgagatccgggatccggaaaaagtaggacttccttcgccgaacctaagcagtaaatatattttttcctgtggagagaatttcttcgcttatccgaataattataactattacgtctcttattacaaaaatacattccagcacggaggaatctcgatggaggagatgttggtgccgtttattacgatggaaccgaaataaatatcgtttttttgttcgtagatggtaggttttgtttaattttgcgaaaaaagaaatatgtttatccataatgaaatacgtaagaatctttccttgttctctgatatatgtaagaatcatgggataaaatcgttgtatgcgtttggatcttcagtgacagagcaattcaatccacagaggagtgatattgacttgttggtagagatggaggatatggatcctttagaaaaaggagaaaaattactttctttatgggataagttagaagatttctttcaaagaaaagtagatctactgactcagaaaagtttaaaaaatccatttcttttagagaatatagataaaacaaaaattctattgtatgacaatgaaagaaaagaagtatttgtctgacatgatgagggcgataagcttgatcgaatcgtttaccgcaaatactagatcttatatggagtatacagtggatctaaagacgcaaagtgcggtggaaaggcaattggccattataggtgaggctctaaatcaatatgacaaacaaccggaacgtatatcgctaaacaatacacggaaaatagttggttttcgtaatcggattatacatgcttatgacagcttggatgacacattggtttgggcgatagtcgttaatcatctgccggccttaaaaagtgaagtgaaaacattattggaaaattgttaagttagataagatgagcacactgaaaatagaaagtttggataagatccatgaggcggctaaggagtttatcgccgggatggatgatcgtacggtctttgccttctatggtccgatgggggccggtaagactacctttatcaaggcgatctgtgaggaattgggtgtggaggatgtgatcaacagtcccacattcgctattatcaatgagtaccgtagcgatacgacgggagaattgatttatcattttgatttttaccggatcaataaattgagtgaggcggaggatatcggaacagaagactatttctatagcggagctttatgttttattgaatggccggagaaaatagatgagttgttacccggagatgtggtaaatgtcacgatctcggagaatccggacggttcacgtactgtagaggttaagtaagtctatggatccttccgaatactttatcttatccttgtttatcgctttgggattgttctcaatcgtagcggcgatctgtaattttgattggtactttaaaaccagcggggcgatgactttcgtgaactggttcggtcgtggcggcgcacgtatcttctatgcgttgttgggaatcgggctgatcgcttgtggggcgctgggacttatgtattggtgataaaaagtaaattatacttacttgtcctagtaagtataatcaaaatgcctaagtaagtataacttcgttgtctgatgaagttatacttactttgaaaaaggccttattccgctaattggaaatcgagttgcttacgttccagattcgcttgcgctactttgatagtgatagggtctcccaaacgatattgacgtttcttgcgacggcccaataaacaataattcttctcatcaaactcatagtaatcgtcatccagatcacggataggtacgagtccctcgcatttattctcgttcagttctacgtaaagtccccattcggtgacaccggagataacgccgtcgaataccatgccgagcttatcctgcatgaattctacttgcttatatttgatggatgcacgctctgcgttggcggcgacttgctccatgttggaacaatgatcgcataaatcctcatacttcttttgtataacgctacggccaccagctagataacgttccagcaatcggtgtaccatcatatccggataacggcggataggagaggtgaaatgtgtatagtattcgaaagccaagccatagtggccgatattctccgtggagtaacgggccttttgcatggcacggatcgccactgtctcgatcaagttctcttccggctttccttgtacattgtccaataaggagttgattcctttggagacatccgtcttcgtgccgtctgttttcaacttatagccgaagcgacggataaaagaggcgaaattctccattttatctgggtccggaagctcatggatacgataaacaaatgtcttcttagtctttcctttaggaggacggcccacgaactctgctacggtacggtttgccaatagcatgaactcctcgattaacttattagcgtcttttgagaccttgaaataaacacggactggtttcccttgttcgtcgatctcgaatttaacctcatagcggtcgaagttgatagcgccactcttgaaacgacgttcccgcaatttcttggcaaggtcgttcaaggctagaatctcctctttataatctccctcgccggtttcgatcacctcttgtgcttcctcataggtaaagcggcggtcgctcttgatgatcgtgcggcagatccgggagttttgtaccacggcatcgctatttagttcgaagacagcggagaagcataatttttcctcgtcgggacgtaaagagcatatttggttacaaagtcgctcaggaagcatcggtatcgtacggtctaccagataaacggaagtcgcacggctttgcgcctctttatcgatgacaccatccgttttcacataatgtgttacgtcggcgatatgtacgccaacctcccagttcccgttatccaaacggcgtgcggaaagggcgtcgtcgaagtctttcgcgtccttcgggtcgatcgtgaaggttgttatcccccggaaatcctcccggttctcaatttcctccggagagatcgcttccgggatcttatccgccgctttttctaccgaggaaggatatttgtaaggcaatccgaattcggcaaggatcgcgtgcatctcggcggtattctgtccggcgatacctaatatatcgatgacctcacccagtggattcttggcttcatccggccattccacgatacgtacgatcgctttgtcgccgttcttgccccctttcagtttatccttagggatgaaaatatcgttagccaacgtcttgttttccgtaatcaagaaggcaaagcctttagctacttgaagtttacctacgaaagtacgctccttgctctcaaggatttccacgacctcaccttccggctcggcacctttacgtttggcgaaaagctgtactttcaccttgtcgccatccatggcatgcccggaattacgttcagcgataaataccggcgtacctccgtcttcggggatgaaagaattctttccattgctacggcgtgcgaaagttcctatggctagggtgcccaatccgttgagacggtaacggccacggtcgatctcagtgatgatatcctcggcggacaagtcatacaggatgtctaccacctgcaatttctgcacttggttctcgactccgatgatcttgctgatttgtttatagttgaaaggttccttgggagaggattggaaaacggaaatgatggcttggatcatcgcttcttttttcatacgtttaccaacacccttttccttttttccttttttctccttattgttatctttttttgctggtctattctttgccattctgtataattatttgcatttgtttttgtgaagacggggcacgcctcgtcttttgcacgccatgtctacaaaggaaacaatttaaattgatatttggttgacaattgtgttaattagatttattaagctcgcggattcttaatggaaacaattcgccggcacccctttcgctccgggcttgcaacagaatacgctaccgcttagtggatattcctcaagctgttcctcactcaatccggcacgggcagtcgttatataaagcgtgtcgagcttatcccctccaaaagcgcatgacgctacgtggggggccggtacgacaatttttgtcaacaggtcgccggtatagggattgtaacaataaacaccgccacctccccattgagccacccaaaggttgtcgttgcaatctatcgtcattccatccggggagccggtgccctcgggtatatttacggctacgccatcgtacaatatgtcaccggagctatcgtcataccggaaacgtatgatcttacgggtaggtgtgtcgttgtaatacatgtatttcttgttggcggaccatacgatcccattggagatcgtgacttttgtcaactttgtttcgacggttccgtctgcccatacacaataaaggctggcagcccctttaggcgcgccaaatcccatggtgccgatccataagcgtccggacgggtcgcatttcccatcgttgcaacgaatcttcccgttattgtccgggattggggcgatagatgccgtgttcccatccgttaggtttacacgtatgatctcgttttgtaaagcgacgactaccgtactgtccgtttccggtacgacggtagagaccatgcggtcgaactgccatgaacggcagttttgcaagtccggtatatactcatataacgtctttccttcaatatctacccagaaaagtgtattgcgatcgggatgccaaatcgatccctcccctgtagtaacttccgcccgaaacgccagatcggggctgattataataggatcgtttatacaagaggttccttcaaacatgataaatgccaatattaatttaataactatttttttcatggtatgctatgaatctgagtttacaaaggtataaatttgttttataatgccatgataaaagattatttatgtaactttgccgcttaaataaaattaccgatgagcgtagagataagagaagttaccagtaagaaggagcttaagaaatttgtcaagttcaatatcgaattatacaagggtaatccctatcacgtaccgggtttaatagaggaagagatgatgacgctggataagaagaaaaatccggcgttcgaggtgtgcgacgctatttacttccttgcctataaggacgggaaggtggtaggccgtatcgctggtatggtgaatcgcccgagtaacgaggcttggggacagaaacgtgcccgctttggtttcgttgattttattgatgatgacgaggtggttgatgcccttttcggtgctgtcgagaaatgggcccgcgaacaaggcatggaggagatccacggtccgatgggctttaccgatatggatcacgagggtatgttgatcgagggtttcgatcagatcggtacgatggctacaatttataattatccctattaccccaagcaagtggagcgtatcggatacggaaaggatcaagattggcatgaatttaagatctatataccggatggcgttcccgagaagcatttgcgtatcggcgagatcgtgaagaagaaatacggattgaaggtgctgaagttcaagaacgctaaggagattatgccttacgcccgtccggtattccatacattgaacgcggctttcgctcccttgtatggtttcgcgcaattgaccgagaagcagatcgattattatatcaatatgtatatccctatgctgcgttatgatttggtaacgctgatcgtaagggaagaggataatgcggtggttggctttggcatctccctgcccaacctatcgagagccttacaaaaggctcgtgggcatatgttacccttcgggtggattcatttgctgaaagcgttgaagagcaaaccgaaagtaatcgacctgtatttgacaggagtcttgccggaatatcaaagtaaaggcgtgaacgctttattatttaatgacttgattcctgtctataagcgtatcggtgccgtttacgccgagagtaacccggagctggagacgaatagcgccgtacaagcgcaatgggattattttaagcgagagcatcataaatcaagaagagcatatattaaaaagttataagagatatggatgagctgaattcaacgatacaacaacctacggaatataacgatgatgacatcaagacactggactggatggagcatatccgccggcgtcccggtatgtatatcggaaaactgggggacggtagctatgccgatgatggtatctatgtgttgttgaaggaggtgctggataactctatcgacgagtacatgatggggtatggcaaaagtatcgaggtgactatcgaggaaggtacggtagccgtacgggattatggccgtggtgtccctctgggtaaagtcgtggatgtgtctagcaagatgaataccggcgctaaatacgatagcaaggcgtttaagaaatccgtgggtttgaatggtgtgggtatcaaggctgtgaatgccttgagtagttatttcttgataaccagctaccgtgacggagagtgtaagcgggtggaatatagtaaagcgatcgtcacggaggaatcggatatccaaccgaccggggaggcgaacggtacgcaggtgttttttgtcccggatcgggagatctttaaggattatcattataaggacgagtttatcgaggggctattaaagaactatgtcttcttgaactcgggactttccattatttacaacggcaagcgtttctattcccgcaacggtctggtggatttgttgaacgagaatatgaccaccgagcctctttacccgatcatccacctgaaaggggaggatatagaggtggttatcacgcatagcaaccaatatggagaggaatattattcgttcgtgaacggccagcataccacccaaggcggtacgcacctttccgctttcaaggagtctgtaggtcgtgtcatcaaggaatattacaataagaatttcgagtattcggatattcgtgcgggtatcgtggccgctatcagcataaaagtggaggagcctgtattcgagagccagacaaagaccaagctcggctcgaaagatataggaccggacggccctacggtagcgaagtttatcggtgatttcatcaagaatgacctggataactatttgcataagaatatggagacttcggagcttttgctgaagaagatcttggagtccgagaaagagcgcaaggcgatcgccggtgttacgaagctggcccgcgagcgtgcgaagaaagcgaatttacataataagaaactaagggattgccggattcacctgaccgattcgaaaggggatttgctagaggaaagcagtatctttatcacggagggtgactcggctagcggttctatcacgaagagccgtaacccgaattaccaagctgtatttagtttgaggggtaagcctttgaatagttatggcttgacaaagaagatcgtttacgagaacgaggagtttaacttgcttcaagcggccttgaatattgaggatggcttggaaggtttgcggtataataaggtgattatcgcgacagatgccgacgtggacgggatgcatatccgtttattgttgattaccttcttcttgcaattcttccccgatttgattaagcgtaatcatgtttatatcttgcaaaccccattattccgagtacgtaaccggcagaagacgtggtattgttattcagaggaggaacgcttggctgccatagccgctgccgggaagaatccggagatcacccgattcaaaggtctgggagagatctctcccgatgagttcaagcattttatcggcaaggatatacgccttgatccggtgacaatgaagaaagaggacctcgtgaaagatatgctcgagttctatatggggaagaataccatggagcgacagaactttattatcgataacttagtggttgaagaagatgtcatcaattgaaaataaacgtattgcgctttttcccggtaccttcgatccttttacgatcgggcatcaatccttggtaaggcgtgggttggaactggtggacgagatcgtgatctcgatcggtatcaacgataagaagcttacctatttctccttggagaagcggatggaagcgatctggaatctatacaaggataatccaagggtgaaagtcatgtcatataatcaattgacggtggatttcgctaaagaggtcggagccggctttatcttaagaggaatccgtacggtcaatgatttcgaatatgagaagacgatcgcggacgtgaatcgtaagttgacgggtatcgagacttttatcttgtttacggaaccggagcatacgcatattagctcaagtattgtccgtgagttgttacgctacggcaaagacatttcccaattcgtccctaaagagacgagattgtattgaaaattatgaaacgaatatatctgatgaaaagaatcgtcttatccctgctgatcgttctaggtgtgtttaccggagcgacagcgcaaaaagcgaatatggatgcccggaagctccaattggctttattcgctatatctaatctatatgtcgactctactagcgagacgaagttggtggaagacgctatagtcggcatgttggataagctagaccctcattccaattatatggacccagaggagacgaaagagatgaccgagcctttacaaggcaatttcgatggtatcggcatacagttcaatatgttgacggatacgctttacgtgattcaggtaatccccggaggtccctctgagaaggtggggttgatggcgggcgaccgtattatccaagtagacgataccttgatcgccggcgtgaagatgaagactaccgatatcatgaagaaactacgcggaccgaaaggtaccgaggtgcgtgtgaaagtaaagcgaggcaagtcgccggaattgatggatttcaagatcgttcgcggtaagattcccgtgtatagtctggatgccgcttatatggcggataagaatactggttatattaaattgaaccgtttcgccgcttcttccgccgatgaatttagggaggcgttggagaagctccggaaacagggcatgaagaacttgattctggatttgcagggaaatggtgggggatatttgaatatcgccatagagttagcggatgagttcttggataaaaaccggttgatcgtttatacgaaagggagtaagcaacctcgtgaggaggcgaactctaccgctcgtggacaattccaagagggacgtttggtcgtgctggtggacgagtcctcggcttcggccagcgagatcgtctccggcgctattcaagattgggaccgtggagtgatcgtaggtcgccgtacctttggcaaaggtttggtacagaaaccgattcccctgccggatggttccatgattcgtttgacggtttcccgttactatacacccaccggacgttgtatacaaaagccttacgagaacgggaagatggaggagtaccaccatgatctgatcgaccgttataaccggggggagttgatgagtgccgatagcattcatttcccggattcaatgaggtataacaccttggtttccgagcgtaccgtatatggaggtggaggtattatgccggacgtgttcatcccggtagatacgactcgctatacggattatcaccggaaactggtagcttccggtttagtcaatcgggtgtccatgaattatctggatcgtaatcggaaccagatgatggctaaatatccgaagttccagcagtataagcaagatttcgtggtcggagaggatatcatggaggagcttctgaagatggccggcgatgagaagattgagtttgaggaagagcaatataatcgttcgaagccgttgatcatgcttcagatcaaggcgcttatcgcacgggatctctatgatatggcgcagtacttccagattatcaatgatgataatccgagttaccagaaagcgcttcagattattaataataaagaaacttacaataggcttttaggacgttagccaacgtaaacagataagggtatgtattggacgctttttctgacattcgtgaaaatcggtatgtttaccatcggaggtggatacgccatgttgccgcttatccagcgggatgtggtggaccggggatggatgacgaaagaggactttatcgacgttttctccgtggcccaatcgttgccgggtattttcgccgtgaatatagcgatcttcgtgggttataaactgaagaagacatggggcggttttgtttgtgccttgggtacgattctcccttcttttgtaatcatgctcttgattgcgttattctttacgcaggtaaaggataatgtatgggtggagaaggcgtttatgggattgcgtccggcggtggtcgccttgatcgccgtgccttgtctgacaaccgcacgttctatcaagttgagttacgtgcaaatgatcatacctgtcggggcggcattgctgatctggatgggtggggtgtctcccgcttggattatcttggcggctatagccggaggtttggtgtatggtttaaataagaagggctgatatgatttggttgcaattattatatgtatatctgaagatcggtatattgggctttggaggcgggtatgcgatgttatccttgatacaagccgacgtggtggaccgctatggttggatttccttgcaggagtttaccgatattgtcgctatctctcaaatgacacccgggccgatcggtatcaatagcgccacctatatagggtatacggcggtgcataatgcggggtattcggagacgatgagtatcctagggtcttgcctgacgacattcgcggtatgtctgccctctttcatattggttctcttgatctcttatttcttcgctaagtttcggaataataaatatgtagaggcggctttccttggattgcgcccggctacggtcggtttgatcgccgccgccgccttgctattaatgaataaagagaacttcatcgactacaagagcttcttgatctttggcgccgcctttatcttgacttggaaattcaagatacatcctatcttgatgattattttggcaggtatcgccggagttattttgtattattgaggatcaaatcggctcaatttgagctgattctttaagaagaatgactacttttgagccgataaaagataggtggaatggcgtttattcttacttcttgctcgatataacgcaaatccgctgacacaccttttgtgcggaggtagcgagatcgtgggaaagaagtggtgataagcgtgctttttcgttaaaaagaggccgatttgggacataataggtgacgagacagcttgcgagaggacgcattccttgatgcgtatacttgcgttaggcgttgtgagcggctgtgcattgggttgtgagtacctgtgaataggcattcgtagcctgttacaaccctatcgtaacactgtttcaccctttttcttgtctaaatagatgaattaggatgaattcatttcactggaataaaagactgtttttgggtattcgtctattagcgagatgattgccgtttttttctttcgtatttgggagtgagccgtacctttgcccggaataatcgattctccgggacttcggttatcattttgtcaaattgtcaaatcgatggccttataaatatatatccacacgctttcctgtcgatgcaattgcccgtttaatcggtgaaaacagcccctttttctagtctggttgcccatgtttttaaggtaatatagttttgctttcgtaaaaagatagaaaacgaaggcaatatgaaacaatacgctttattattcgcatgtctgttcttcctctgtgtagggagtaaggcacaagagcaacctacccgatggacgttgcgtgcttgcttggattacgctttggagcataatatccaagtaaagaaaagcaaggtgtcgcatctttccggtatagaggatacgaagcaggcgaaagcacagcttttcccttccctttcggcttcggttacccaaggattcgtgaattatccttcgagcgacgccgctacgaataatagctatagcggtaattatgcgctgaacgctaaatggacgctttttgatggagggcaacgtgtacaggcgatcaagcaacaggaaatacaaaataccgtcgatgagctgggtatcgagcaaaacgaggatgatatccaaatctccttgatacagacctatatgcaggtactatatgcgatggagtccgttcgtatcaaccaaaatacggtcgaggtatctacggcgcaacgggatcgtgcggtggagttgctacgtgccggttcgatctcgaaagtggatttggctcagttggaaagccagttaagcaccgataaatatcaattggtcgtagcccagacgaatctagacaattataagttgcaattgaagcaattactagaactggatataaccgaagagatcgaattggtgatgccggagcttacggagaaagatatcttaaccccgcttccgagcaagcaaacgatttacaatacctctctggccgtgatgccgcaaataaagagcagtgagctggccgtggatatcgccgagctggagaagaaaaaggcgaaaggtgctttccttccttcgctctccatgaacgccgggctgggtaccggccatctttccggaacggattacgctttcggtagccaggtctggaatagtttcaacgagagtgtcggattgacgatcagcatccctatcttcagtaaccgtcagtataagacggcctataacaaggcgaaatacgcgattaccaccagccagttggagttgctgaatacccaaaaacaattgctgcaaaccgtggaggggatctatctggacgctacctcgtcgcagacccaatatacctcggctaccgaacgcttgagttacgtgaaagaaagctataacttgatcgatgagcaattcagcctcggtatgaaaaatacgcttgagctattgacggagaagaacaattatctgaccgcccagcaagagcagctacaagcgaaatacatggccttgatgagcgttcaattgctgaatgtttatcagaagaagccggttgcggagaattattaacccactaatggatatatttactccactctcttttttcaaggttaccctgcgacggaggtcgtggggggccttttgaacaagaatacaacgtaaaacagaaataaaaagaatcagaatatggacaagaagaaactaatcatgggcggtgttgccgttatcctcattgcggggggcgtgttccttttcacgggcaaatcctcgaaaggcgggatcaagctggagaccgctaaagtagggcgcagcacgatcacgaatacggttacggccaccggtacggtagagcccgttaccgaggttgaggtaggtacgcaggtctccggtatcatcgataagttgtacgctgattataacgacgtggtgaaagccggccaactgatcgccgagatggataagatcaacctccaagccgagcttcgttccgccgaggcgcaattggcgagcagcaagacggagttcgagtatcaacagaagaactacgcacgtagcaaggtgcttcacgagaaacaattgattagcgatacggattatgagacggctacctataattacgagaaggcgaaggccgcttacgaccagagtcaggcctccatggtaaaggtaaaccgtaatctcgaatatgccacgatcacgagccctatagacggagtggttatcaatcgggctgttgaggaaggacagaccgttgccgccggcttcgagaccccgacgctgtttaccattgccgccgacttgacgaagatgcaggtaatagcggatgtggatgaggcggatataggtaatgtggaggaaggccaacgggttagttttacggtggatgcctatccgaacgatcaattcgagggcgtggttcgtcagattcgtttaggggacagcgaaagcacttccagcgcttcttccagtacttcttcttccacggttgttacgtatgaggtagtaattacggcggataatccggacttgaaactgaaacctcgcttgacggcaaatgtcacaatttatacgttggaacgtgcgaatatcttgaccttgccgaacaaggcgcttcgttttatccccgagcccgccatcatggaatcgttgggtatgaccgtgacggatccgaatgcggaggtacaacccggaaaacgcttggtttggtcccgccaaggaaataccttgagcccgaggcagattacggtcggaaccagcaacaacagcgtgaccgaagtaaccgagggcttgagcgagggcgatgaggtagccgtagatttagcgagcgccgccaacatgccggaagtaggtgcaggagcggagcgtagccccttcatgccgggccctccgggaagcaacaaaaataagagatagtttgcgtcatgaaagaaattatcacattagacaatataaaacgagacttccacgtaggcgacgagaccgtccatgccctgcgaggcgtgtcgttcacgattcgcgagggggagttcgttacgatcatgggaacctccggctccggaaagagtacgttgctgaacacgctgggttgccttgatactcctacgagcggggagtattacttagacggagtatccgtgcgcaccatgaacaagcggcagcgagcgaccctccggaatcgcaagatcggattcgtttttcaaaattacaatctgttaccgaagacgacagcggtagagaacgtagagcttcctctcatgtacaatcctacttataaagcggcccaacgtagggagaaggcggtcaacgctttgatcgccgtgggcttgggagaccgactgatgcataaaagtaaccagatgtccggtggccagatgcagcgtgtggcgatcgcccgtgccttggtgaacgatccggcggtgatccttgcggatgaggctaccggcaacttggatacccgtacctctttcgagatcttggtgctcttccagcgcctgcacgccgagggacgcacgattatcttcgtcacccacaacccggagattgcccaatacagcagccggaatatcacgttgcgcgacggtcatgtaaccgccgatacggtgaatacgaatatcttgagcgccgctgaggctttggcccgcctgcccaagaatgatgattagaataatgaattaatgtggtaatagcatattatttagaatgaatacgacgaatttactaaagatagccctccgggccttggccaacaacaagctgcggggattcctcacgatgctgggtatcatcatcggcgtggcttccgtgatcacgatgctggccatcggtcaaggctcgaagcggagtatacaggcgcagatcagcgagatgggctcgaacatgatcatgatccagccgggagccgacatgcgtggcggcgtacgccaagacgcctctgccatggagacgctgaagctacaggactacgaggatatcgtgaacgagactcgctacgtctccgccacctcgccctccgtgaacagtagtgggcaggccatctatggcgccaataacgccccgactaccgtctacggtattagcccggattatatggagatacgccgatacgaggtggaggatggcgatatgttcagcgatcaggacgtacagaccgccgccaaggtatgcgtgatcgggaagacggtggtggataaccttttccccggcggagagaatcccgtcggtaaggtgatccgtttccagaagctaccgttccgggtcgtgggcgtactgaaaagcaaaggatacaacagcatgggaatggaccaagacgacctgatcttagctccatacacaactattcaaaaaaagatcttggccattacccatttgcaaggcataacctgctcggcgctcaaggaggagtacaccgatcaagccatagacgagatatcggagatactgaggcgtaaccataggttgcgggaaaccgatgatgatgatttcacgatccggagtatgcaggagttgagcacgatgttgacaagtacgacggatataatgacgacgttgctggctgcggtggctggtatctctcttctcgttggtggtatcggtatcatgaatatcatgtacgtgagcgtgacggagcgtacgcgggagatcggcctccgtatgagtatcggtgcgaaaggcatggatatcttggctcagttcttgatcgagtctatccttatcagcgtgaccggaggattgatcggcgtgcttttcggcgtgggagctgccttgatcgtgaatgtcgtggcgcatttcccgatctatatccagccgtggagcgtactgctctctttcgtggtatgtacggtgacgggcgtgttcttcggatggtacccggccaagaaggcggcgcagctcgacccgatcgaggccatacgctatgagtagacggatgctcactagataaggctacatggctcatataacggtaggaatgactatatttgcgtagcactaaagaggataataagatgaatgacacaccacaatctccccctatcaaaggtttgggaaagttgatacacatcgcgggatggggtatcctgttctgctcccctttcttcttcacggggagggagtcgcaagtcacgttcgagggctatttccggagcatcatcgtgccgctttccttcatgctcgtcttctacttgaattacgggtggctggtgaggcggtatttgtttaaccgccggacagggcgtttcctgttgatcaatctattgcttatcggggctacgatgctgttcgtgcatctctgcatgcgctatttctatccgccggagatgcatcatccggctcgtccgccccgcccgttgaacgagacggtggggttctttctcgtcaacgccgttatctactccttggtagccggccttagcgtggcgatcaagatgacggacggatggtaccgggtggcggctatccagcgggaactggagaaggagcgtgccgaggcggaattgcagaacttgaagagccagcttaacccgcatttcctgtttaatacgttgaataatatctatagcttgatagcgttcagcccggagaaggcgcaggaggcggtgcacgatttgagccgcttgcttcgctatgtcttgtatgagagtagccagccttttgtcccattggagaaggatttcgacttccttcgtaattatgtggagctgatgcgtatacgcctgcccaaacatgtggagctgaaaacgaatatcgtcgcttcctccccgggaaccttgatcgcccccctgttgtttatctccttggtcgagaatgcgtttaagcatggggtgagcaataataagccgtctttcatccatttggatatccatcaggagggggcggaggtagtttgtactattgtgaatagctatttcccgaaaagcccggatcaagataaaagtggttccggtatcgggctggtgaatctggagaaacgcttggggctgctctattcggggcatttctcgttccaatgcggtcgggagggggataactattcttcttatctatcaattactataaacgagactgagatatgagattgacttgcgcgattattgacgatgaacctttagcggttagcttgctggaaagctacgtcttgaaaactccgttcctggatttacaagggacttataatagtgccttggacgctctttccgacttacgggatcggccggtggatctgctttttctggatatccagatgtcggagttgagcggattggagttctcccgtatcttgaacgccgatacccgtgtcatttttacgacggctttcgatcaatatgccgtggatagttaccgagtaaacgcgctggattatttgttgaagccaattagttatccggacttccttgcctcggcgaataaggcgttgcgatggtatgagttgctccgtaagccggtgtcttcggaagagaaggaaggatccgcgccaatcgcggagaagggcgggatggagagtattttcgtcaagagtgagtataagctgttgcaaatagagctgcgcaagatattatatattgaaggattaaaggattacgtgaagatattcgtggaggatgagccccgtccggtcctttcgttgatgagcatgaagagtttggaggatatgttaccttcggatcgctttgtgcgtgttcatcgctcttttatcgtccagccggagaagatcaaggtgatcgagcggaatcggattgtctttggaaaggagtatatcccgatctccgacaattataaacagcatttcctagagatgatagagcgtagatcgatcctgccgaaataaccgctggttagttgaacaactggagcaataatttctctatcgctacggtcataggacgtccgtcgcaggaatagttgtttacgaatagggcgatggcgtattgcttatcgcctttgtttatatatcccgcatatccttttacccggctcatgcttccgcttttaagatgagcttttccttggagggatgagccttttaagaagttcctcaccgagccttctacccccgctacgggcaatgattcgtagaaggctgtgtgttgttgtgaacaggttttcatataaatcaataaatcagccacaaaagctgttgataacttgttggtaaccgcaagaccgctaccgtcgtacatccagacgcacgagaggtcgagtcctttcccttgccaatagtcccgaagcacctggataccccggttaaaagaagatatgacctctcccttacggggcgtatatcgtaggccgatcgtcttgatcaaggcatcggcgaataaattatggctgacatgattggtcacttccacgatttcccgaagcgtaggggagtaagtggtaacaatctcggtccgtttcccgggttgccacctaccggcttcccgcaagatacggaaacaagacggtgattcgccgaccgtgatcccttcatgttccaattgcctagtgagataatccgctaggaaaagagccgggtcgggaatatcccctttgagcggataccattcccggttagcggggacaatgccatataaataacgatccgtggcgaatggcgcccctacgataaaagaactatccgaagatacttgctgggtcgttaagtaattatggaaatggatgccggataattccggttcggttcctttcaacttcgggcgggttccgggagctccggtttgcaaccctaatttataaagattgtcgaatacgcaaatcccatagcttccggcaccataataactacccatatcttcgccaacccatttaagggaagtgccttccgtgtcgaatatactttcatcagcgattacggctccttgtattttatggatacccaccttcttcaaggcggagatccattcctgtagaaaccgcttatgatccggggcgaaatgcgctgagccaaggctaggatctccgcttcccttgatatataaattgccttttaacaagccgttctcgatggagccgtcgtattctaatgttgtgggaaagcgataatcctcgcccagtatctccaatgcggtagcggtcgtaaccgttttcatgaccgaggctggggtcagctgccggattgtatcgtaagcgaataccgtctcgccactgttaacctctttcacgatcaaggaaaatgaagctccttccatataaggcttgcgcaggaattgcttgataggttgtggagtctgtgcccccactgaaaggtataagcaagaaatgaggaagaaaaaggatattttacgtatcatgatgtttatatattctactttattctatctttgtcgcaagcaaagatatgaaaataatatgaatccactgtttgacaagccttttacgtttgaccgtgtaatacgcatagtgttcggtatactggtcatctcaggaattatttatttgatagccttattacgaaacgctttgttacctttcctgatcgcttggttactggcttatatgatgcaaccgttcgtaaagttcttccaatataaattatgttttaagagccgcatcttatcgattatggcggtattggtgactttagggctattgataacgttgctggtagtcatggtcattccttccattgcggctgaggcggataaaacgctagaactgatccgcacacatgatcccggtgaaggtcatgtccctttgatcccgcattcatggatggaatatctggaaagtaatgtgaacttcgcccagatcatggagttattgagtaaggagaatttgttgaaagcggtgaagcagattgcgccccagttatggtctatcttatcgaacactttctcaatccttttcagtatcacgatcgtgttcgtgatcttgctttactttattttcatccttttggattatgagaagatcgcgaatggttggatcgatttgataccggagcgttaccgtccgttcctgcaaggtttggctgaggatgtggaatacagcatgaatcgttatttccgcggacaatcgttgatcgctctttctgtaggggttctcctcgcgatcggctttaagatcattaatttcccgttggcggtcacgttgggtctgtttatcggcgtgctgaacttaattccctatatgcaggcgatcggtattatcccgatgattctattgagcttattgcgttcggccgagactggcgagaacttctggttgatctttggtatggctattttagtcttgggtatcgtacaatgtatacaggatttatatcttacccctcgcataatgggtaaggctatgggactgaatcccgccatcatcttactctcattatccatctggggaacgatcctaggctttataggcttaataatagccctcccattgacaacattgtgcttatcctactataaacgctttatcttgcacgaagataatgagttagatcccggaaaccttgctcatcaacctaagcgagagaaaataaattcagatttaagcgcaaaaaaatagccatgcctattgcatattaaaaaaatactcctacctttgcacccgcattacagaagtaacgcacaggatgattcgctagctcagctggtagagcacaacacttttaatctcctccctcgtataggtgataagtcccgccgccgggtccgctatgtagaacttctctttctttatcttgtagcaaaccacgaaatgccattggttccagtgtagtatgcagggtaggggacattccttttccaattcctccaccgtgatccgcacgccctgtgttcggaacccgatcgcttccgccgcctcgctgatacccagcatggagactccttcccgtgtgatgaaggctttctcccgtaagttctggatcgagtacacacgaccatagaacttggcgatcatacggaggcagctaggaccacagtccatagaatccaattgctgataatgtggaaacgatcttagcataaattaaaacattaggatatagacatgatttagttcttatttcttatacttgatcagcataatcaccggattggactcttcatccaatgtagttgcgatctctttcagtttgcctttcaatcgtcctttcccgtaagcctcggcaagttcgtgggcttgcaatgactgtccgattacgaattccggatctaaaggtctcgacgtcatatccacttctcttttgctggtataatcaccattgtatattttaggtatgaataaagaattttccagtctatcgtacatcaaaccggaaattggaaaccctctccctgtttcaaaattaaattccgctttcaacaggctcatgaaataataacggtcggtaaaagcggttggtataagaaatacttcaggaggatccatggagtgtatggagggggttcttacgataagggggattgtcgtattagcatccggcaaatagtggtatatggtatcggatgatgtctccataagtacccaattagtatgatctggaactatttggtacacagcggttggaactggaacagcccaagcttccccatctcttgcgaccgggcttttaacttcatcaaaaggaattgatattttccgggtgatacttccatcctgcttggaaaagattaaataatatggaggtatggcgtttgacgggttttccagactattatccggtacataagagatcaaattatcccggtcgtaattaaatgtatttatatgagattccgtacctacggctttgaaactccttttaaaatttccgtctagatcatatactgagattttacttccggtataggctatgacaaatatttccttgtttgcttcatctaaaacaatttcagtaatacctacatattcctcgccaccttgccctttcctgtttatcttcttcaaggctttgccggtttttctgtcaaaaacaaacaaattcccgtcgttggcccagttggttattaatataacttctgcaccaatggccattactttgccttgggtaacaaactcatcatttgtttccaacgggatgtattccacatccatgaaatcctgtagtgtcaattccttttcaggataattctttgtaacatcaactgtgatgagttcatttgttgattgtttatcttttccacatcccgctaacgtaaagagaaggatcgctgaaattgtgattatccatttcattatttttacgatttaaggttaaacacttagggcgatacgttcgctcaatcatgcctaattacaaaaataggttattttttctcgatatctcttctttttgctcaaaacttatagcggtgaatggaattctatccgttatttacataatttaggcaaaggcttagcaatggatgttgtttcctctcgctatcttgtgggtcacttatcaagaggtcgaagagttcgcttatttccgggtcgttgattcccggatcatccttttcggactccagatgccagctgacccatgtttgtccttccaacttatccagatcattctctagctcataatgcaatgtgggaaggtggaaaacgactatagtcgcctgttggaaatatttcctgtcggtggttatcacccaatcaacgggtacatcctctattttcaactgtagatcttccccatttatcgtgttgaatacgagcatcacttttttaccagcctttatttggcaatctacgcctgctacccaatcagacacacgccaatccgtatattctttcagcccggcttctgccttgtagtaataatttctgcatctttgtatagattccggaatcatttgcccgcaatccctccaaaatcgatccagataatgtttgtgtactatgtatgaggaatcttttatgttgggaagtagtgtgaaggccatggaataaagcctgaggatgtttacataccaccagcttctcaagtcaacgctcgtcttagaggaaacaaattgatcagagaatttaatcaatccctcagtaacttgaaataatgatttcagccttcgggctaggcttgtcgtatgcatgaccgattcttcgttctggcggtaataataaaactcaatgttggtgataaccatcctctccgcttggcaaaggacgatgggacaccataattcatcctcatgcatgatgccttcctcaaaacgagcctgtattttatgcagatatttcctattgtatatgtatctgacgggtgtaggcaaatagaaacacgttttgactaattctatgaaaccttctttaccggaaagcaattcttttatagatccgttggaaatacatttaaaaggtttatccatacttccgtcttgatggcatagccacatatttcccatcacgacatcggcatgatgtttcacggcctcatcatataaaagagataatgattcatctttaatccagtcatcactatccaaaaaagcgatgtactttcccgtggcaatatccaaaccaacgttgcgggctgcggatgctcccccgttctcttgatgaatcactttgatacgctcctcttttttagcgtattcatcagcaatttcccctgacaaatcagtcgagccgtcattaaccaagataatctccatgcgtagatcaccttggttcatcaacgagtcgatacaaaccgtcaaatatttttctacgttatatatcgggataatgatcgatatgtcgatttgattgagcgtattcatataatagtatcaagctagttgtttattacttacattcttggaataaggatttataaaatgcgatcatgtttttcccgaatacttccgaggaatatttctccaaataccgtttacgaccgttcttcccgagtcgtttcgcttctttcgggttctgtaataggtagatgatcttctgtgctaacaaagaggtgtcgatctctacattattaggagatactattaatggtactttcaatccgcaagattcgtctactacctcgttcaatcctgatgtggcggttgcgacgatgggtaattcatgcatcatcatttcgacaggtacataaccaaaaggctcgaatagggaaggtacgacaccgacattggctatttggtataattcatatagatctgttctttctaagagcccagtgaatgtgattcttgtacaaatattcttagcttcttgaaaaaaggtatcataatcaccattcccaactattatcagatggcaattaagatctgtttttaatacctcataaaaagcccttattaaataacgtattccttttacttgatcaattctacctacaaagaggactactttttctttactttgtaaatgccattttttgcgtaaagaattgttttttattgatatgtttttaatgttgcttaatccattttgaattacggatatttttgatggttttattttgtaatattgacataatatattttgcatataatttgataaacaaatagtatgatccgttactaaatagtctttcttttcttcttcaattgtttttttgaaatttagagcaaaattatctgtgttatttttgtttaataggtgttctaattggtacttgttgtcaaaaataataaatccccattcggaaaaatgtgcaactgaaattattttgcaattaaacattttttttaattcaattgcaaggcttgtacattgatgataatttatgtgaaatatcaattctttttcatttgttatatgtatttttagcaagtaaactatatttttgaaatataattccctttgcttctgattgtctaatgttctcaattctaatattggatttggaaaataccagtaatttattccatcgatattatctatttgtatttgtggtttatctgacattaaatttattatagaaatatgaatgtcgctatcttttaaggcaatgactaattctctaatataggttcctataccaaaaatagctcctctacgggtttcgttaaatatgtataaattcataaatgatatttttattagtagtttataataattgcatccatctggtatttaatgaatttaatgttgttaattgcaacaatcctttacctgcaaaaccgtcaagaatacccattgattttggtgatatttctgtatctaaataaaagttgttattgatattgtcattatgctgtggatttgtgaaatagttataatatttaattattcgtgctttgttgcctattatatgattttttagatgaggaaagtatctattaatatgttttgatgagaatagatcccatttgtaacattgctttaaaatgtcggtacaattactaaagcttgatgttttttgtaaatcatgtaaaaaacagtatatatctgtttgttcatctggagaaatattggataaattgtctttgatttttattattatatgcgttaagcactcttttgcgtatttagagggtgattgataacctaatcgcataatccaatatcttccatacccagtcaatccatcatacatattgaaagattgccaaggatcatacatgactgctctatacattctttcatcaatatcttcataaatatcatcctctgaagtcaaaaaattattttgaattagataatcaattcctacacctataccagctattccattttcgtaattagcaagactattagaatgaatttgattttgtatttcataaattatatccatagcataatctgcaaataacatgttttttgtgtattgtgaataatggaaaaaaaatatagcaatccctgtttttccatgtattaatccgggagattctgttaatgttccattgagtataagtatatctgatgttttctgtaaatcgtattctatttctgtttttgatgtcattgtttaaattattttttatgttttaataacatgattactggatttgaatcttcttctaaatttgcagctatttcttttaatttaccttttaatttacctttattataagactcaattagttgttcagtatttaaagattgccaagttaatatgtcgcaatttacagggattgagttcatatatacttgttttttgtctgagaaatctttattatatacaatgcatttaaacaaagaattatcttgtttgtcatatactatattagtgcgaggaaagcctttttgtaatccaaaatcatattttttttctacaatttccataaagcagtagcgatcagtgacactgcttatgaaaagaaatgtttccggattcatagattcaatagatggttttcttatgataaatggttttaattgtaaatcagaagaaaatgtgaataatgtatctgatgaaggttctataagtatccaattattgtgaataggaattattggatagtcagaagatggggtagctccatatgtcattccattttttgggtcttgtaaaagtacagcagttagtatttttttattaaatggaattctaatttctttagtaatatttccattggattttgatataagcataaaagattgttcatttgcttctccattattactagaatatccatcgtgacataataaattatcttggtcaaaattatatattttatcatacatagtaccttctttatgtttaaaacttcgtttgaaattcccttctaaatcataaaccaatatttttctgctaagattgtcattaataaacatctcattattatcttcatctaatgtgattcctaaaataaaagtatactcttcacccccttgtcctaagtggtttattttttttaatgctttaccttttctgttgaaaataaaaatatctccatctctgttgtaatttcttaccaatatgatatttttaccaatattttgtacaaaaccttggcatataaaagtttcatttgtttctaaagctatatattctacatccataatatcttgtaggattagctcttttaagggataattatctgtaatatctattgttataaaatcattatctgattgttctttttcttttatacatccagatatgataaataaaaataatcctaaaaatatataagaatatctcatgattgaattttttgaatgttagttgcaattcgtatttatatgacataaattcatacgtccaatttctatttcataatttgatggtggtgggcaaagccattgataaatgcaggtattacatggaattttattgcgaatattaaaccaagaaataccttcttctacttctttttgtactatttcagaaatactgtgtgtgtatatattacctaatactggatgatttaaattggcaaaagcatcaccatttggtaaaatactaatttttccaaattcgtaaatatttatagattgattagcaaaaaaatcttttatagacatagtagttgataaaatatcatcttccgtaagaaaaacatattctttgaagaaatcaatattacctcctgtatatattggtttgaagatatattttttgatttggaattgatcaataagtctttctgccatttcataatcttctaaagatgatatatttaatatatactcaaatgagaaattcttgttggataatatttgtatagaattatcccattctttcgtatttattgggaaatttactgttattttgtaatataaattatctgtatttgataagtttaataatgtaatatttgaatatgagcatacaatatttatagatgaattgtgtttttctaaaaaagaagaaaagtattgattatcatctatttcattattgttactgataatattaatgattacattttctggtaatgtttgtaaaaaagaaacaagatctacagctttacttgtttgatctatataaatactaatctcagatagtttttctaagatacttttataaggtgaaaaattgtgtattttgtataattcatttttgtaattaaggttgtaatatggtaatatctgaataggttttccttttgaaaaactaatatcaataatatctcccatatacttatttctcagatcagtgatgaaatcaaaaatatcagaattgtgataaagatctcgttttaatagaataactccacagtcttttttttgtaaaaaagtatttagtaattcaattacttttgcttttttgcttattaatatttttccatcatatgtattatatagtaatgcgcaattattagcaatattgataaatacatatggttcgattgtaaaccaataatcattttctatgtccatgaatgttataaaattacttcgttttctattatttgataaaaatcatttggatatttttctaagaaagaaaaaattcgatgtaatctatttgtaaattcttttgaattacaaaaatattcacaaataaattctttggaatctacattgtctataccttttatatgaaataaacatgtattgcaaaatttatttgaataacaatgtttgcaaacatttttgatatggtcaaaataaaatttatatcgttgtgttatttttggaatatctaatattacttctttattaatctctccaattgcatatttatagttaactctttcgcagggtaataacttattattagttgtcatcaatatttttttacctcctggtagacaagtgcttgtcggtaaatatttttctactccatataataaagatattatatttgatatataaaaatttaaagaattgtattttaaaaaattagtgagttctttataggtggataattctgtatgcattatgtctaaaagatctgtattttcatttttaaaaacattttcgctttcaagtttattgtgaaataatttattataatcactttttttatctgattttaaatcatcaaatgctaattcagctatacgtggtatttttttatatcttccatatataaattcatatatttcttttactgagtttctgttatgtaatacagcattaaatcttatatgattcttaaaatattcgggatattccttttgaatcatgtctatattttcaattactttatggaatgaattttttttgttgtttcggtaatatctatagctatgatttttttcattaccatctaagctaataagtaattcaaagttatactttacgagtaatttaacatatttgtgaattaatgtagcatttgttgtcatgctatattctacctttatttcttttttgtaatttaaagtgtttacaatattgattatgttctctatgaattttccattaaacaatggctctcctccgtaaaaagcaataattaaattttttgttttacttgtagatttgagtttaaaaatatatttcaacattttttctgcataattgatgtctatattttttatatttctttcatcaaaaccttcgtatagttctccaaatgaacaatatagacaatttaaattgcaaaaatctgttacttcaaatgtgatttgtgaggttttagttatactttcttttatcatagattcgtttaaagaaccaaaggtactcggtttaggttccgaaaaaagaccatgtctttttaaatattcgtatttttttaagtaatatgtatccgcttctgctggattttcatgagcttttttaagatcagggtggatcagcatagataatctagatttgtgatcatatatataagagttattattttctgttgtgtaaatcagtgttttaatcatggctgtaatgtttaaagtttcatcgataaccgataattttaacggttatcgatgaaattagattagtatccgtaattattttggtaactactacctccagaccatgaaccatcggaaccacatccacaggccgttccacaactacatccaccttttaatgcattcatttctcgacgctctaattcttctttttttagctgttttaatttaagcttacctaaatttttcattttcttgatttgttaagttagacgatactattatcgttcgtaaaattaatagtgttgtttcatgtaaaaatagcctacttaagtctattttttgatatttgtaatgcttcctgcatagagtgaacttttagtttgttaaataatgcttttatttgatttcttatagtatgttgccctttgcataattcatttgcgatctctacagtgtttttacattgttgagcaagcataagtattgctttctcacgttctgtaagtatttctattttatcttgtttccatcgtctggtaatgaaattgtattcttcgtatgttgatttgtctttgttatgtaagaataaatttccagcctttttatctgtagagttttctacaatacaaataaggtaacgtaaattgttatttagacaaataggtttcatccgttgatataccatttgtgataggaagtgtgatgaaaaagaatatttgcgaagcaaacgaagggtacaagaaaaataatctatttcattccatttatcttttcggtctaggtattgaggaatgatcttaagtatgtttgtccataaaggcaagtcatcaggatggattatctgtgtatagaaatcatggccaagcctcatcgcttcttccacagaatgatcacataagaatagattatcgggtttgatatagcaaaattgcttttgaactatatccaatacgtagaagctatcggtgataatagaagagaatagtttacagtattgaataaatacagactcttgctcattaacggtatctgttattctcccagcatattcggaaaaaagatcttcaaaggtattcataatcatattatttttaggttaattctttagtttgctcatgccaactgccgaaaaaataatgtatcgcaaatgatttttcaactttgctctcaatactcatagatgtttcctcgttcatgatttttcttatatctgaatgagttataggcgcaatgatttctgccggaattaacgtaatccgttcctgatatttactattatcatatatccgagttgttagaaatgggcctgtggtgttaagtattaattctactgaatcagtgtatgttccggcttttgtgttatcataaaaaactgcatcgatcaactctttgaaataaggatgctccggaactgttgccataaaagcatttccaacaatgtaaggtacatggatacggacagcgtgagcttccggttccaatcccatggcacattctgtattacataatataggggtgatattttctgtacattcataatccatgtctacatatagaccaccaaacttataaagtattaaataccggattgcgtcccagcgttgtacattatgtgaaaaagcattataggccggaataaattccggataataggttttcaaaaatgtctcaatatcatttttattccaaaaccgatactcccaatcgggatttagctctttccatgattgggagatctcgactaaagaaggaggtggtcccgctaaatcctcatagatctgatgaatgatctgtggaattttaggatgtatatgattatttcggattgcggcgacaaagtgctcttttaagtaaaagtattctttaggcatatacagttcctcgaaagatgtattatattctttggtttgtgaatataaatcggcttctatgtccggacagatgaaagatggatgaacaatatggtcgatttcctcgtttttgatgttggtaaatggatgattttttatagcatggggcattttgtcataatatgcgatctttgttattaaatttttgtttggaatgatcgataatcgattattgataaggttcgtgtatgcgtattttacctcccaaaaatgttcattactgtgatttgctatattgaagagcctgttccagcgatattggaatggagcgtgagaaggtaaatttgataagtaatccagttggttaaaaagatcgtacttgttttcgttaaggcagtgctcttgccaaactcgtctccaaccagcccatccggatacgtgggttaggtttgaataatagaaagtaccgtctcccctgtttttcccgaattggtaattgcttccggatatgtgtccgatgcgttcatcgtgtctgaacttttccagcaatgtcgtacaaaaaccaaagaatgaaatggaaggtacacaatcatcttctagaatgactccttctggctcttgctcgaagaaccaagaaatcgaatcaaaacagtgtttgtcgtatccttgatttttttcctgatatagtttaaatacttggcattcccagtcaatgtgggaaacaatgaacgttgtttccttacttattttacgctgtgtgtcattagttgatccatctactgcgatatatagtcttctcggtttcaccactttgatgcgatcaaatacttgctttatatttgatcgattaaaagctataaggagaatcgctattttggggtcgtagattatcataatatgtattagttcttgattaatgacaaacttagtatttttgttaggttacgcttagaattcctaataacatagttcaatgcaagcattcaggaaaaacgtatcattgggggcactgtacagtgattatcacaatagtgatggatcaactatataatactgtttaatcctgaagcttgcatatgataaagaataatacctaattattttgtatgatgaaatctcccgtaagctgccctaggcgatgttctaacactacataaaagcatcctgtgccagcctgatctaaagagatggatacacattcacctgcttcgccggagactacttcgttatataggatagctccttgttcatttacaacttgaacagtcaaatcatccagagcatctataaaatgtatgcttaatagatttccttcgattgataatgttggaggagcaggagtgacagagcgataataatcgtcatgccatcctcccttggtcggtacatcatctccataaactgacagtggcgaaaagaggccaaatagcatcaataaggttaataattttgttttcataatattttgtttttctttttgcaaaagaaaagctttattctctaataacaatgaacatggatgaacaattggcattttcgtttttgttcattttctaacactgattataggtcattgatatatagatcgaaatcggaggcttttcctgttttgccactcatcttcagataaagtcttttccgtaagactgatatattactatggtttaataacatagaaagacgtgagggtttcacatggattctcactaaatagcataaccgttccatctgtatcggtattttggggtaagcttcttgaagtttttgtgcaaaagacggataaatagcgtttataagatgaaacaactcttcccaatccttggtagatggtttccaatcctcgttttcatgaaagtttttatatacagatgaattcttcaaattctgtaatgattcaatctgatgctctttttgggcatataatgtttggtttttttgttcgaactcctgccgcagctctttcttgagttcttcctgttctcgatctttctcttgtaaagatttgtttaatgtctctatgatttgttcattatgctctatctgtttttcatatgctaggactgttttatcataagagaaaatcttttcccggttttcttcttggattttcaataggtctttttgtcttttcttgtacttaaacaaaagataagtggttggtagaattatgcagagagcaataagactgattacggccatccataggttcgcataggccgttcttactcgttcctccgctaaggatttttgtttatcctgttcatcgtaaagagcttgtttgcttctaatcatattcgtgacttctgcttggttaagtgtgtcacgcatcatttcatattgttgactcaacttcgcataaaggatccattgttttttcgatagggctatttgggatagataataaacagcccccgctctcgtgtccaatcgccccgctttttccgtgcattgttccaaatagatttttgctgaatctaattggccgcaatgataataatatttgcctagtgtcaaatagaacggatgaatgttatttcccaatgcctgcttgtttgccatgacttcacggagtagacgctctgccttcgggtaggtctttgtttctacatatagattcgatagttctgaataaacagagagcaccttcctgctcaccatcaaatcgagagtttttgaataacaggcgatagcgctgtctttttgatggagcatcctataaatacgtcccagatctcgaagcgcatagacttgaccgatagaatctgctattgccttgaaatgcatgaccgctttttgctgataaggtaaggctcgctcatatacgtcttgttgggtataaagcatcccgataccgttattaatcctccccagtaatgcatggtcttcaatctgctcctcattctgtaaggcatttaagaaatactcttgcgctttcaatggatgatttaggttttgattgatccgtcccttataaaaccaagctttcgcttttcgttccagatcgtctgtttcctcataataatccgtcgcgatcgtgatcagcgagtcggtttcatgcttaacaaaagtcttgtcttgtgtttctgttaacagcaaataataatgtgccttatcttttcgggataggttttctttgttctctatttgttcaaggagcattaaggcgctatccggatgtctcctccctcgtataggtgataagtcccgccgccgggtccgctatgtagaacttccctttccttatcttatagcaaaccacgaaatgccattggttccagtgcagtatgcagggtaggggacattccttctccaactcgtccatggtaatccgcacgccttgcgtacggaacccgatcgcctccgccgcctcgctgataccgagcatggagactccttcccgtgtgatgaaggctttctcccgtaagctttgcacggaataagcccacccgtaatgcttggcgatcatacggaggcaggtgggaccgcagtccatagagtccagttggcggtatgtggggaaagatttaaacactatttacaaaggattaatatgacataaattaaaacggttaataaatagttcataatcggaaattggaggacatatattttgatatatacaggatgaacatatggagatattttttctgagaagataccataaatgattatttgagaatgatttatttaataaatattcgatattagaatcgctaatatttcctatactagcaaagttattaaaagaagtgtatattaatccatctgaatcaaccattaaccttccataatagaacgtattaatgattgatttattatatagctctctcattgataatttgtaattttcaaagtctttcaactctgtaaatacattatttttaaaaaatagcatattatctccgttgtagaaaggatgtaatatgattttatcttcaatggaatcagggatattcaattctctatcaatagccatatgataagtatagtctaaatttaattttgatattttcttatcaaataaaattaagagatttatatcgtaatactcattaacaagaatagctattttgaatttaaaattagttagcatagacaagtctatattcattaaactcatgatattaaagtatagaataatttcacaatctgcacgatttataaaatctgaaatttttttatcagaaataaaatcaattagatattctcctaaaaatgatattgaagatattcgatgaatcgagattttatgaataaatattagtatagattctttatctaattcatgatttcctaagttagatttacaaaatagaaattggcgatagtattttttacaatagtggcaattaaaactgcaatgcgagttgatataaaagattaaatctaaagatttgtcttcttttaaatcatctgtgtctaggtttttaaaatatggttttaaaatgtatggattgtatttattttttaaacacaataaatctccgctaaaactatctcttatccattttataagtctcatccattctttatctttttttattgtatcgatttcaatatattttccataattatcctgcatgttgatttttgtaaaaaagtcaactatctcttgactacaaaaagtctgatttgcaccagataatgtattataaagtaaaacttgatcatttagcatatcaacatatgtaaagggctctaaatataaataatattcaacttccataaatatttgagttttgtacttaaaattactataaattatttcaatttcacaatagctaatactggattactgtcaatcgtttcttttttgaaaaaattaccttcaattttaataggatatttctccaaatattcaatcgtcaatagagaaataaaaacactctcactagaagatgattgccaatatggtaatatatcaggtccattagtgatattatctataaagccaggataaatgttttttacattaagtgctgacttactttttttatcgaaccaaatattgaagaaattgcctttataagcaaatacaataattatggatttatctgattctattatgtttctaacagatattatttgggacaacttatccatattcttaaaatcattttcactacgtcttacaggaccagtgtaaatttcatatataggcttaatagaaagaggaatgctaatttcatatactaagtcagataatggatttttataaaaaatacctgctttatactggtaaaaaaacggcatttccagaagtaacatatccatagatttatcatcaattgtggtcggtaaagaatctataatatcacccttatcattggtaagatataattctttgacatttttatttttatcaattctattaaaacgattattataaaagagtatttttttattgcttttttgaatcatccatggagtaaagtctaagattattctatctataaactcccctaaataattgtatataaatattgtttttgattgtgggctaataatatatacgtatttttcaatttcatcaacatagaaattcaatgctgaagtataatcagctggtccttcacccttttgtcctatagtatttaaaaaggatccgtgtttatcaaaacggtaaaacctctcattcttctgatctccaacgaatatcgcatctttaccgtaaaaaatctgcagttcatcactcaacaaacaactatcagtagtttctagaggaatataaacgattgaatcagctacttcactaaggtttactttttcataatgatctcgctgatcataaatattaattctaatctgcgcagtcaataagaaagcttttgaagtaaaaataaaaaagcataaaaaaaacaatttcataatttaatagatttattattttctaaatacgtaaatatatttgagagataaattgaaaatcttcttattgtcatatgcctattacaatagtatccatctcccttattttgcagtgtaaaaatacaaaaactacataacatcgaataatagcattttttacattgacttatcaccgttttgatatttttattgtattgttcagcaatatatttatgattgatgttttgaatatttccattattgcatattaatccataattattattgaagctgattttttcacaaggcattaactgatattcagcagtgataaataacttctttttaagaggaatacatgtacctgtatacattcttttgttagattttttatgcaaatattcaggaaatgaatatatatctcttattctaaatatttctttctgatatctatatatatgtttatttattataaaaccatctttaacggaataattagtgcgaaacattttgttaaatactgatatattatcttcattcacatctattttattaagagatccagtatttaccttatctgtattcaaataatttaagaaaaaatgttttatatttagatttttgtttttatcatgaagtaccgatatgtaatgaatattatcagaatagtatctaggatatttttcttttataaacatcatgttatttataatcgtattatatgtttcatttccatttttatatactctatacctatttgattcctcatttccatcaaggctgattgctaacacaaaattattttttacaaaataatctattttatatgcatccaatagagttccatttgtggttaatccaaaagtaaaatttacactagtatttttagacttaatatattctgttatttgttgaatatcttcaaatcttaataatggttctcctccataatagttaattcttatatttttagttactccaaattcccaatagcataataatctatcaataattttttgtacatcgtttgattttattttattgtatttaaatgggtttttatatagacttccatagatacaatatttgcactgtaaattacaatcttgtataagctcaatagctagctgttccgtatttgatatggattttattatatcattttcacttatattatcaatgaataaatgatctttaacagcactttcaaatacaagatacctagtatagaaatctatttttctttgataataatcaatttcattttcagaatataaatcagtgtttgtgtattcatatttattgttttcactcttgtttttaagcaaatgtatcattattagatgtatatataatacacatccaagcgaatttgaaaacatgtatgtgttcaatttcgacgtagtaaatataacgctcttaaatcttgccataatacaataaattaattcattaggagctttggctcctaatgaatagtgattgattaacggtgtgaatcatcttcgagtacagcatctgtcatgcttgttgaaaatgttcctccgcactggcaatcgtaactagaacaaatgccaccctttaatttacctaaatcctttttttggatagatttactcgatacttctactaacttaatttttttgactgttttcataatgaaaaatattaaaagttatacaaatctctaattttacttaaattaacattagagtatttctttatatacgtttctctcatcatatattttactttgtttatttctttattgttaattgcatatattattgcatctttaatcttattaatctctatacttgcatctctttttttatattttatatttattttcatttcatgagggacttctacctcattcaatgctgtggaatcagtgataacgataggtaaacaaaacatcatcatttcaatcattgtataagatgactgttcatgaaaagatggaagtattcctaaatctgatatttgatataaattatacagatcgtctttatctaaatatccaaaaaaagaaattctactgagactatatctagctaaatttatgcaactaccaaaatctccgtctcccgcaattatcagcctaacattcttcttatctttgagaattaggctcattgactctattaagtattgaataccttttaccctattcaatcttcctgcaaatattataatataatcatctggtgaaaaagagtatttttcccttaacttccttttttctgtatcagttatttctacataatggtcatctaaacaattacgcataaaatgtaacttactttttggaatcttatacaagcttataatcacattctgtataaatgtatttaaacatattattcgattagatatattgtaaaaatttctttcaataatatatgaattatgtattttcaaatcattgctatttgtattatctaaattattattaactatattctctttaaaatacattaagtttccatctagtgctaaacaccatttttgataatgaacagtaaatatgattgctatattatttattcgattttttatcaaattagccaaaaagtaatcactcgaataattaaaatgaaaaatacgctgacttattttgctgtcaaaattggatattaagagataatatactgacaagtaatattttttaatatctttagttactatgggaatttcatgcagtatataattaccactttttataactttatactctctttcttgtgaaaataaatttatctgatttacttcataattatcattttttatcaatgtttctacaatctgttttatatattgacctataccatagcaatttgctgtgtttattctattaaataagtatattgctttcatgttactatttatttagattacatttttattcaaaccaactaatctaaattgatttattttgacgatgcattttaatatacaattatcctcaactatatctgctatacttaccgatgatttccagtcatataaatatctattatcaaaaatatgcatattcttatttgatcttagacgagacctaatataacatgatattcccattagtcctgtctccaagctgagatcttttattcttagtaaatcccgctccatgactttttggtcgatttccgcaaggatttcattggagtctccttccatgaacccattttgaatcagatattcgataccccagccaattccacataatccagtctctaggtttattggtaatgtttctggaatattctcgcagatttcttcgagcagttcccccgcaaagtcatcatatatagttaagcctgtatatcttgcgtagtgcgcaaagaacaaaacaactcccatcttcccatggaataaaccaatatcctccatgtcgattgagtgcaaaatcagatgattcgcaattcttcgtaacaatatgtctttttctgttttcatcttatcaacattcaatttttatgtttgaatcctttgcaaagcctagcaataattctttttgataagttttgcttaatgccaaacaaacaaccttacttgggcttaagattcgtaaaatcgtctcaaacgtatttgcgtataagaagagtctagggaaattttgttcgacactatcattctcaaataccttttgttcggaaaattcaacttgtacagctgtaactgtctctgatagttctgtgtcatccggaatctcatattcagataataatagaatagggatctcttttccttgtaaaaaagttgatacatgagccaattctttctcatctgttaggtaaaccaaacaacatcttttatatggagataaaagccttgtccaaggatggctgtctatattaaagttatttgtggtatcccttttcttttctatccactcaaaatgattcaagaaattagagatattgcgaatagactcctcgatggattttccggcgatacgagaacgtgtataatccatttgttctttcgaaatgaaagacagtatatatacgaacaatgcgttttttatggaatggttgccaagcatgagtcttagggtatccctagcctcatattcttgaatagcttttcttatatattcttgtatgattgtatcaaattcaattttgtatttttccaaatctagtgaactcgcctttccctgaaacttctcttgcctccaatttaccaatgtgcgccaaggaattgaatgacgttgcgcagaataaaaataagaaaacatgcgctcaaagtgtgaacatatgaataaattttttcttcttttcagctttgaataattacatttcttgaatttctctacaggaatgaaccgatcctccgctttttcataccaatattgataagtttcagtgtgcttttgaagacatggacgtaaatgaaaccatatcagaccaccatcaaatagctttttattatgaaacattacttccagaacttgattgtagccgggagcttttggcaaataacaagcttggtaggtcatttcttcagagacctcgaaaaagaaaagatctcgcactccgttgaatgggcatagaatgtcccggtaggttgtgtctatcttttcgtctcctaaaaaagtaagccattctccgcttttttgtaacacattgataccagagagggataccaatattttatcttgtttgattctttttttcaaataggagaaatagaaaggagccatctttatcgctaaccagtcttgccattttctttttggacttttgccctttttaggattatgcaggtaagatatgtatagcttataagctagttgttccaaagggttgatccggactttttgctcggtgcggtaggcatcacaatattttttgaatgattcggaaaaaaatagctggtctgaatctatcttgatcgcatagcgatatgttacttttgaaatcgcataattcgtgtatccggaaaggagatgaatcgaatccttcggcagattcatggtctcttggaattgttcatccgttaaatctataggatagatatagggttggtattcaaagattttgatcttgttggggtatttgctctgttttcttttaagtatattagctgtctcatctgtacaattgtgatataccgcaatcagctcatctaatccttcaatacaagactctatgcaagcgtctaggaaatccgcgctgttttggcagcgcaatatacccgttacccctaaagggcgttcttttgtcaattgtgataaatcgacagtgtattcggtatagtcctgttgcttagagctcatggtaattaaattattgattcatttctaattgattttgagaaaaacaagtttcccaaatttttttctgtatatagctctctctataaggactatatggcaaacctctttgtgcatcttctcctatgtactcttttctaaacattaaatatgtatgataatcctttagtgtatcgtcattcaaaatttctgtttcttgtatctttatatctatatccgataatacatctttgatctcaccggtaataaaacgttctcttaatagataggtgattccccatccaatgccacataatccatctgacaaatcaagagataaattatccggaagctccattatagattctaatatctcgtccgcgaattgttcatataaagcatctccactgtaacgactgtattcataaaataggatagtcatgcctagcttaccgttatacaatccgggatgctctagagcctctgttttcagtaccccgtaacggagtaggtcttttagtatgcctttgtattgaatgaataactctttcatatcgttcattaattgtaaaatgaaaaagtcgtatcccagctaccaaaaaaataatgagaacaatatgcttcctttattttttcatggaatgaggcggtctctccctgatagatatatgaacccatgtcatctttcgtcacaggcgttacttttgaataagggaaaagagtaaccttgtatcttttcttcaaggtattaaatatccgtgatatcatcaatgggcctgttgtatgcatcaccttttgtgctggatagtcccgtaacattgcatcagtaatttcttttaaaatgtttatccatcctccgcatcttggctcagaaaccataaatgcatttcctattagggtggatacacttgggtagaaattatgctccgggggctcttcgccaaatcctatcatcacgtcttttaataatggttcgattggcttgaagcattccgtatccaaatccgtatagactcccccatatacatataatatcatatagcgaatcgtgtcccaacgttgtacattgtatgggaaacttctatacatggaaagatactccggaaaatgtttttctaccaactcatccatttcctctccgttccaaagatgatattcccaatctggattctgctctcgccaagttcttgccaagatttgtaagcgggtgggcatacatggttctgtgcgcccctcccagacttgatgtatgattttagggattgccatacgctttattgattctcgaattctccaactagccatcctaacttatgaatcaagaccgcttggtatgtgtctgtttctatcccgtccaatggaatgttgataatatctcctgtttctccggcaagtatattctcatacattatattatttgcatgatccatgatgcggatcgttagatcatctaatgcttccgtgaaatgaatgcttaagatatttccttctatagataatgtaggaggtaatgcggggatggagcgataacgttcatcatcccatttcccgtgtgccgggatgtcatctccataagcaaatgtgatggagagaaatgatcctaaaagaatacataaggctaacaaatgtgttttcataacgctattattgcttttattagtagtgtgactacgatttcatgttgacgaagatcagtaaaaaagcaacaggaaaatgaacaaaaaatgaacaagagcataattatgaaaaaaagatttgtgcattttttgtttagtttcttggctgatattctatatagtgctataaattagatatatatcgatctagatctttggcatttcccttcttgccagttaacttctcatataatctttttcgataaatggaggcgtttcccaaattgagtaggatcgcgatcgcccccggctttacccctattttgatcagatagcagatctttttctcggattcgttcaagggaacagacttttgtaaatctatcgcaaagtttgggaaacacgcttctaccgtaacgaaaagcttgttccaatcgtcgtttgttggagtccaagatatgggggagcgaaacttgtcatacaatcgtcctacctgtaattgcgctaacttctccttccttgtttcctcttggtttcttaaattggaattctctgttttgaggatggatatgtctcgctcccggctttctttgatacgggataatttctccagttgtttacgctttagctctagttgctcactcgtttcttttagttgtttttcattttcttgagctagttgttgttcttttattttatattcctgtatatcatgtgccaaactatccctgacataggataagtcttttatctctcgctcttttttaaggatttgtttctcattgtcttttaatcgtcgcaatgctttttttcgctcctgcctataacggatgaacgtgaaaatgcttcctactagtagaacaaggcagcctattatggataaagtataaaagaacttctgttgggaggcgtaaagtcgtgcttcccacaagtctcgctcaatgtcattatatgaatagaacgcttgtacattccggatagattcggcctgcatttccttttctatagaatcccgtagcgactcgtatctatgggataatgaagctgctagttcccactgcttttgagtgaaagcgatttcttttaactggaaaagtcctccggcacgtgtcttaggcaaaggtgcggaatctgcgcatgcttgcaggtaaacacgggctgagtctatttgcccacattgttgaaaaagttcacctagtaccagatatgttggatatttagcctgtggctttgccatatttcgtagggcgatgtgtaataattcatatgcttctcctatctgttgtctagatacgtagagatctgctaattcagtataaaccgaggggagaatttcttttcccattaaggaaatggctacttgattactcatgatcgcactatccttgtatccgagcatcgagaaagtacgccccaagtctcgtaaggcgaatatctgtcccatggaatcctttagcatgcggaaattctcgacagcccttttctgaaagggcaatgctttctcataaacagtttggtatgtatagagcatccctatgctattattgatcctgccaagcagggcgtaatctgttacctgctcctcatcccgaagtgccttaaggtagtattcctgtgcttttaatggatgccccaagtcttggtttattcttcctttataataccatgccttcgcttttcggttcacatattctgtcttttcataataatccgtggcgattgcgattaaagagtcgctagtgtgtggtatataatttttatctttcgcttccgtcagcagcaaataataatgcgccttatcttttcggggtaggttttctttgttctctatttgttcaaggagcattaaggcgctatccggatgtgacccaaaagtaaccaaaaggtcaaggctgacgctgacgggctacttcgagacctgcgctcgctgtcgcatcccaactcgctacgctcaaacagggatgctccgggcgctcgctacggtctctccgcttcacgcccgtccgctgaggccgtccaaaggaaagcgtcgctttcctcttatatcagccgggatatcattattcattattcattgttcactattaattattaattatcatgaagaagtctgtttggagtaccattctcaaagtgatcatcgccgttgctaccgccatcgcaggggccttcggcctgcaagcttgccaattgttttagcaagcctcccccacccgttcccactccctaaagaagacaacctccccaaaagaggacaccctctacccagaaggacagtctttctcaaggggccggcctctcctcaaagagccgggaacggctcttcctccggccttagcgggcgggcgttaagcgaggcggccgaagtgagcgacaggagtgtccctgtctgagcgaagcgagttgggacgcgacagcgagcgaaggccgacgagtagcccgtccgcgtcagccttgaacttttggttacttttctttcaagagaaaagtaacacacaaactaaaaaaagaataaaaatgaaacaatattgcttttaccagaattacagggaggttcgcctccttgtaattcattgcagcgcaacacgctacgaccgggattttcccgtggaagcgcttcgaggcgcacataaggatcgtgggttcgctgacatcggctatcattactatatcacccgggatggcgagctgcaccgctgccggccggagaaccagatcggggcacacgcctcgggctggaacgatcacagtctgggtatttgctacgagggcggattggatgagcgaggacttcccgctgatacccgcacctacgcccagcgttgtaccctgctcgatctcttgcggcagctacgccgtgattacccgtcggcacgtatcttaggacattatcaactcagcaccaacattcgcaaggcttgcccctgcttcgacgcggagaaagaatatcaattattttgaagacgtattgtattgttttccataaaatgtaactatatttgtagatatatacgcagtttggaaagtaagtactggctaaaatcaactattaatggataaaaaattcaacgaaatagaaatttccaacttcaggggcttcgattctataaaaatagaccgattgtctggattgaatgtatttgttggcgctaataatgtaggtaagagcactatattagaagccgttttcatgttggtaggtatggccaatccgataatgcccatgcgggtaaattactggagaacacagactaattccgatatggacagcttgaaatacctgtttcataatattgattttaacaatcagcctctgttaaaggcaaaaaccggaacttctgtacgaagactcactttctctcccttttttcgaaatacgaccgaagcctcttccagtgacatctctttaaaatcaactgtcaaacaattgaattttgattttgatgtgcaggaaaaagatggcttctcgtatcatactgccttattcgtcggtgtggacggaaccctgcaacaaacgctagatgccacttataaggaggatttgaattgcttgttcattcctgtggacaaaaatgacaataacgcatccagtaattttgcgacattggtaaaaaggaacaagaagcaggttgtcattgatgctttgaaagagtttgatccggatatagaatccatagaagctttaccggatggattatatcttgccatgaaaggattgcacgaacttctgcctatcagcatggcaggcgatggagtaaggcgcatgattaatatcatggccactatcgccagcgaggattaccacattgtcatgattgacgaattcgacaacggccttcattataccacccacaaactgatgtggagggttttgctgaaattcatagaaaagcataatatacagctgtttgtaactacacataacttggagtgcctgcaaagtcttgaggctgtcatgcaagatgacgaaagccttcgtgaacttgccaatgtttacaatatcgcaaagactaagcaggctggttttcaagcttacagatattcctttgaaggattgaaagaggcgattgacaatgaaatagaaatcaggcgatgaaagaactttttaagattttcgttgaaggagacgccgataagcgatttatttcacagctattggaatttttatttaagacttctatcgatcagggtaatattatcaaaacatccggttggaattgtctcgtttctcctaaaacagaagaagtttatgtgaatcagatgaacagaacttcggcagatggcggtgttaaccttgtaatctttgatgctgatgctgattttgaagacaggaagaagaaattaatcttgtggaaagaacgctgtcatgtggatttcgagttattcctatttccaaacaataaagatacaggagaattggaagatttgttagaaaagataatcaatccagaaaatcaacctgtcatggattgttggaccagctatgaggaagcattgaaacaggtagtattgccttggagagaagatacccctcttacacttcctgcgaaaaagacaaagatatatgcctatctggaggtattattagggacctctaaaacacagaaggaaaaaataaaggaacctaatagagaatataggaataaagaccattgggaccttgatgcggatacgctaaataatttagttgtttttttaaaggaacatttatcataaaaaagatacgacatgaactattacgaactcagtttcacatacacctcccctatcgagaaagagattatcaatgacgtgctggccgccgagttgggggaaatcggttttgagagctttacggaaagcgagaagggtttgctgggatatatatccgaggctttatacgacaaaaagacattggatgataaactggccgactttccgctagagaatacccggatcgattacacctccaaatgggtagaaagcaaagattggaatgaggagtgggagaaaaattatttcaaaccgatccggatcggaaacgagtgcattatccgtgcctccttccacgaggcggagcccggctatacatataatataataatagacccgaaaatggctttcggtaccggcaatcacgaaacgacttatttgatgataagcgagatgctgaaactagacctagaaggcaaggagttactggatatgggatgcggcacagccgtgctggccatcttggcccggctgaaaggggcgaaacgggtagcggccatcgacatcgacgaatgggcttataacaacgccctagagaatatccgcctgaatcataccgaagacatacaagttgccttgggcggcgccgagaaaatcaaggaattcggactattcgacatcgtcttcgccaatatcaaccggaacatcctcctgaatgacatttgtcaatatacaaacagtatgaaaccgggaagcctcctatttatgagcggcttttatgtagaagatatcccggcgatagaagcagaatgtcagaagaacgggctgaaattggattcttataacgaaagaaataactgggttgccgtgaaggtcttaaaaggataactttttttaacagcaaaagttaagacaaggataaaccttaatccaaataaatacgttatcttagtggaaacttctaaaaagaaaaagttatgaaaagcgtagattcaaaattattacttggccttgtagtaggcgcggctgttggtgccgctgtaggttatttggcagcgacagataagagagaacaattactggaagaattgaacggtgttgtcggaaaagtaaaagaaggttttaactccgctcttgccaaatataaagaaggaaagcaagaagtagtacaggcaacagaagaaatcgtagctgaataagctttgtatggagaaagattcaggaacagtcttccgtgagctgaaagaagatgtatcggcttatgtggagttaaaacttgagctcctaaagttgagcacatatgagagaacgggtaaagtcatagccgttctctcatatggcttgatattattgttcttggcgttcttcgccatcttgttcatattcttggccttgggcttcttcctaggggattggctcggctcctccgggttcggattcggtatcgtggcggtcttgtacctgctacttatcggcattataataatgaatagggacaggatcagcacaaaagtattaaatgaggtaatagccgccatgacggcgaatgacgataaaaataacgcgacaaacgatgaacaaccggcaaaccccactggagaaactgatttctgacaaagaacgcatacagagacaatgtaagcgacaggaacagaaattgaatgaggatttctcttatatacaggagaacgccggaagtttattgttatccggattatcgtctctccttttcccgagcaataagtcaacgacaaaaacaaacgacaagaacacagctcccgtaacggctggacaaccctccatcgctttagggatctcagactatttatccatagcgaaaggcatgattcccatcgcttgggatctcgctcaaccatttattatgacgtggggaatcaaaaaagcgaaaaaatggttctctaatctcttattcaagaaaaagaaataacctccaacaattaatttatgttagagggcagtttttttctcgctatattataaggctcaatacaaaaaacatgactacatttgcagtcgttaaagcaaggataaaatgaatatctactccttgcgatggataagagataaaaataaagacttattattaataaacccataaaaagttttattacaatgatcaaactaggtattaacggttttggccgtatcggacgtatggtgttccgtgctgcagttgctaactttggcaacgatattcaagttgtaggtatcaacgaccttttggatgctgattacttggcatacatgttgaaatatgactcagtacacggtcgtttcgacggcgaagtagctgtagaagacggcgctttggttgtaaacggtaacaagatccgtttaactgctgagatggatcctgctaacttgaaatggaacgaggttgacgctgacgttgttgttgagtctactggtttcttcttgacagacgagacagctcgcaagcacatccaagctggcgctaagaaagttatcatgtctgctccttctaaggacgctactcctatgttcgtttacggtgttaaccatacaacttacgcaggtcaagacattatctctaacgcttcttgtactactaactgcttggctcctatcgctaaggttttgaacgacaagttcggtatcgttaaaggtttgatgacgacagttcacgctgctacagctactcagaaaactgtagacggtccttctaagaaagactggagaggtggtcgtggtatccttgagaacatcatcccttcttctacgggtgccgctaaggctgtaggtaaagtattacctgtattgaacggcaaattgacaggtatggctttccgtgtaccgacttctgatgtttctgttgttgacttgacagtagttcttgagaaagaggcttctatggctgacatctgcgctgcaatgaaggaagcttctgaaggcgaattgaaaggtgttcttggttatactgaagacgcagttgtttcaactgacttccgtggctgtgctaacacttctatcttcgacgctaaagctggtatctctttggattctaacttcgctaagatcgtatcttggtacgacaatgagtggggttattcaaacaaagtttgtgagatggcttgcgttatcgctggtaagtaatttattaccactctacatagaaaaggctatcctctttgaggatggccttttttttcgtacgtttgtatcatgaaatcatatgaacttatcacgattctagggcctacggcttccggaaagacgaccttcgccgccgctctcgccgcccagttggatacggagatcatcagcgctgattcccggcagatctatcgttctatggatatcgggacgggtaaggatttggccgattacaacgtgaatggaaaacaaatcccctatcacttgatcgatatctgcgagcccggctataaatataacgtatttgagtatcagcatgactttttccgggtctatgaggatatgaagcggaggggtaaactcccgatcttatgcggaggaaccgggatgtacatagaggccgtactaaaaggatataagctattagacgtgcctcaaaatcctgagctaagggaatccttgaggaataaaaccttggaggagctggaaaccatcctcgcctcttataagatattacataataaaacggacgtggacaccgcccagcgggctatccgtgcgatcgagatcgaggagtattataagactcaggcaccagacgtaaatgaatataatccgatcaacagcctgatcatcggtatccatatcgaccgggaattacgtagggaaaaaatatccagacgcttgcggacccggttggacgaaggaatggtggatgaggttcgtacgatcttggctacgggtgttaaaccggaggacctgatctattacggattagaatataagtttcttactttatatattatcggggaactttcttttgaggagatggtctcgcaactcgagatagcgatccatcaattcgccaagaggcaaatgacttggttccggggcatggaacgccggggttgcgagattcattggatagacgccactctaccgaccgaagaaaaaatagcgacaacaatgcgaattctaaataatcagctatgataacaataaacgatctaaataaaagcgagaacttcttcttgatggcaggtccttgcgtaatcgagggggaagatatggcgttacgtatcgccgacaaaatagtgggtatcacggaaagactgcatataccctatgtattcaaaggctcctatcggaaagcgaatcgctcccgtctggattcttttacgggcatcggggatgagaaggcgttaaagatcttacggaaggtgggcgagacgttcaatattcccaccgttaccgacatccatgagacaacggaagctgccatggccgccgaatatgtcgatgtccttcaaatcccggctttcctatgccgtcaaacagatttattggtagcggcggccgagaccgggaagatcgtcaatataaagaaaggacagttcctttcgccgggtgccatgcaattcgccgtacaaaaggtagtggatgcgggaaatgataatgtcatgatcaccgagcggggaacgacattcggctataccgaccttgttgtcgatttccggggtatcccgcaaatgcaaacattcggtttcccagtcattatggatgtaacccattccttgcagcaaccgaaccaaacctccggcgtgaccggtggattacccgcccttatcgagacgatagcgaaagccgcgatagccgtgggcacggatggcctatttatagagacccacccggaaccaagccaagccaaatccgacggggccaatatgctaaaactggatttattggaagatcttttgacacgtttggtacgtctacgccaagcgatcctataaaaaataaggggcccttactaaaaaggcccctttatttcttatttttacgatcaataatctaattatcccatcttgctgatcttcttcaaccgatcttcatctatcaacttaatctttctaccgtctaaagcaatgatacgttccgccacaaaggtggacaacgtgcgaatagcattcgatgtagtcatattagatagatttgccagatcttcacgagccaaatagatgcttaacgtagcaccgtcttcttccagcccgtaactatctttcaggaataacaaagattcagctaatcgcccacgaatatgtttttgcgtaaggttaaccgtacgttcatccgagataccgagatcaatggataattgtcggatgaaaaacatagccaaattcggattgctcattaaaaggcccgtaaccactgtcataggaatcatgcaaaccgtagaagcctcgaatgcggaagcgttcgtcaagtaatcttcttgagcgaaactagcccggtaaccaaaatactgcacaggcttaatcattcggataatctggcttctgccacctactccatccttgtaaatcttcactttaccctttaacaagcacatcatgtcctttggttcgtcgccctcgcaataaatcaactcgttacgtttgaaatgctggatcgtcgaattactacggaggatctcacgttccttatcagtcagaaccctccacacctctgataaactggccgataaatcgacctcttctttttgctgtttaaccacgactgctatataacatacttatgaagcacaaatatacgatttttcttttgaaaaaataaaaacttttgtacgattaattacaccatattgtaacattttactttctttcacgtctaaactgaaatttattcattatgtttgtctggaaagaatgtaaaatcgttgaaaaagttatattcgatacttaccttgattttaatctctataagtattttcgcaaagagcactgatacttatagtgataagatcctgtcttttggcaaggggaatcgagaaacgagagaacgggcggactcgatcatgcaccttgtcatcgaaaaggcaacccaataccaaaatacggtatcgaaatacgaggctgagatttatatcaaaggacgtacagaaattttaaaacaaaatatgttaatacgtctcgctcaccatatcttccctatcgaccgaaaaaataaggatatgctttttgagatggtcagccaatctaaatttaacgctccgcagaactatcttcatgatctaaaggcggtcaacggaaacagcatacccaacgggaaaaagcaacaggaggccttggcctttttgaatttgaacgtatactcccctaccgcttacgatgatgccatcttcatgccgatagctagcaacgcttttaagttttatacgttcaacttggaagggctggagactatcaacggcttgacgatttacaaaatccgtttcctgccgaagcaatggagccaaaaattggtatgcggggatctatatgtcatcgaccagtcatggacgatcgacaagatcgatatgaacggtcgttactctttcgccgaattcaacctagtcatgagctacggacgggatttcaggcggttcatcctacccgagaaggcggatctattcctccgatacagggtattggggaatgcggtggcaaccacctaccattcttcctttaagtatcaggaagtggaatgggtggaggaggacaacgaaagccataaatggaaatccttggacctgaccaattattacaaactctcgtccgatacggttcctattatcagggattccacgtattggaatatccatcgtgacaatcccttgagtccggatgaagcccacttatacaataaagcccaagagcagaatataagtaaaatcgatacggccgatgatctccagaagtacgttaagctaacggagcagttaacgaatacggtcaatatggattataaaacgacccgtattaaatattccgggcttctgaatccattccaattgggttattccgcccgtaacggcatcacttacaaacagcgattccgtatcagcaagacatttacccgtgacaaacagattcgtttccgtccggagattggttacgtattcaagcgcaagcagatatttttcaaggtcggaggcgattgggaatactcgccgcagaaacggggaatcttatcggtagaagtaggaaacagtaatgaaagctactcctccgagatcacccaaaagatcaatgaggaattgaaggattccaccttcaatttcgatgatttaaaccttgagtatttcaaacactactatgcggaaataaaaaactccatcgagttattcaatgggtttcaattaacaacgggtatcacttaccaccggcgtatcccctctaaaaagagagtggagatcggttacgctaacgactttacgcccacgctcggtttctcctataccccccgccaatattatcgcatggacggataccggaaggagtatgtctattcttactatcccacgatatcaatcgaaatagcgagaggtatccccggagtcgggaaaagctcaggagattacggacgtatagaggcggacgtgcatcaaagccttatgcttggcctgtgcagacgattgaactatcatatcagcgccggtctttatacacaacagaagtctacctatttcgcagactttaggtatttcacccgcaggaatttccccgatacgtgggatgatcagattggcggagtcttcaatctactgaaaggcgagtggttcaatgcctccgataagtatatacaagcacatttcatgtatgaaagcccttttatcttatttaaggttctccgcatcaactccacgaaaaagttcatgcaaacggcctcacgctatatcctctccgaacgcttttattggagccagctatggacaccggtcttgcctagctatacggaagtcggatacgggatcgggaaccatatctttaatatcgggatattcgccggattcgatcgctggcattaccaaagcatgggattcaagtttgccttcgagttatttcaatgaatcaatagtgggcgggctaccaatatccctttacagctctttatcccctcggcgtaatctcgtaaggaggatgcttggatgattccctttttagcggaagaagaggcatggataaatgtcagttgtccatccttccaataggcgatcccgacatgcgtcacgtccagccccttgatagaagtaacaaaacagaggatatcgccattcttgattccggacgaacatttctcgatctcctgtttaggcacataataatgaggacgtaggtttatctccttttccttatcggccatccttcgaactctttccggatggttcttcagttgcttatagctatccggatgcgtagagataaaagataaatccaaaggtagggaggcaccaccgatttccctccccatatctttcacgattccttttcgctcattctcatagaaccagtccgtcatataatgcaaacgatctgtgtaatcccctatcgtaccctctctgtaccggagccgttgtagattctcacagaagttctcaaaggtagttttttcctctcgcagggtacgggataaagccaatacggtctccgcgaatgtggtgcaatccaattcccgcagattgaccaccaagccctccggctccttttccaaggtagaggcgacataaggagtcccccggaagaaaagggcggtatggatcattagctcgtctaggggtaacgacttcttaggttccatctgagtacaataccgatcgaaaatagcacgatcctcatccgtacaatacaatttacgggatgtatgctcttgggcgttcactaaaaacaccatacatacacacacccaaaaaccgagcagtagcattccccttctcataagctaatcctttttcgttttcagtaaatcctccaatttcaccagctcgtcacggaattgggcagcctcgatgaaatccagtttcttcgccgcctctgccatctgtttgcgagtccgctcgatcgccttctcaagctgcgtacggttcatgtattgcacgaccgggtccgctaccaagcttggttccggctctatataagcgtaaggctccgccgtttgttgtttctcggcaagcatggatacactgtttttcatgacttgcttcggagtaatgccatgcgcctcgttataagccatctgtttctcccgccggcgattggtctcgtccatggtctgtcgcatactcgccgtgatcttatcggcatagaagataacctttccgttcacgtttcgggcggcacgcccggctgtctgtgtcaaggatcggtgggaacgcaaaaagccttccttatccgcatccaagatagcgaccaacgagacttccggtaagtccagcccctcacgtagcaggttgacaccgatcagcacgtcaaacaggccattccgcaggtcgtccataatctgtacccgctccaaggtatctacatcgctatgtatatagttacatcgtacccccatgcgggtcatataagtagtcagttcctccgccatacgcttggtcaaggtagtcaccaagacccgctcgtttttcgccgagcgttgcgtgatctcctccatcaagtcatcgatttggtttaatgaagggcgaacatcgataatcgggtccagcaggcctgtcggacgtatcacctgctccaccaccactccctcgctctttatcagctcgtaatcggcgggagtagcgctcacataaatgcctagaggcgtcaacgactcgaactcatcgaaggtaagcggacggttatccatcgccgagggcaaacggaaaccatactccaccaagtttttcttccgggcataatccccgccatacatcgcacgaatctgcgggatcgtcacatggctctcgtctacgacaagcatgaagtctttcgggaaatagtccaacaagcagaaaggacgatctcccgccgcacgtccgtcgaaatagcgggaatagttctcgatacccgagcaatgccctagctcccggatcatttccaaatcaaaagtgacacgctcatacaggcgtttcgcctcaaagggcttaccgatctccttcaagagattcacctgcgtccccagatccacatcgatctgaccgatcgccatattgatacgctcttgggtggtcacgaataaattggtaggataaatattcagctcatcttgctcatcatactcctcgcctgtcaacggattgaaagaggagatgcggtctatctcatcatcccagaactcgatacggtacgccatgccgtcgaaggtctcgatcgccgggaaaatatccaccgtatcaccattcacacggaaacagccgcttttgaactccagcttattattcacgtacaaggcgtctacaaaccggcgcaacagcttatcccggtcgatacgcataccccgttccagatgcgtcactttctcggcgaaagccgtagggtctgccatgccatataagcaggatacggatgagaccacgatcacgtccttacgacccgacaataaggaagccgtggccctcaaacgcagcttatcgatctcctcattgatcgccaagtctttctctatataggtatcggtagaaggtagataggcctccggttggtaataatcataataagagacaaagtactctaccgcattatttgggaaaaacgctttaaactcactgtacaactgagcggcaagcgtcttattatgactgagtatcaaggtcggtctctgaacttcctttatcacgttagcgatcgtaaacgtcttaccggaaccggtaacacccaaaagtgtctggaaaggaacaccactcttgatcccttccgacaacgccgcaatcgcctcgggttggtcacccgtgggactgaacgaagacgatatttcaaaattcatcctttacccgatctgttgtttaggcattaccaaccacaagataacgtataacagtccgccgaatccagcgaagaaaaccatcaatacccacacgatccgtacgatcgtcggatcgatatccaagtattccgcaagaccggcacaaacaccacctatcatcttattattcgaacgagtcaatcttttcttctcttccatatcttattatatctttatcaatatacaaaactaatgaatctcactcatatttacaagttgaaccaataattcattttgatcatgaacgtatttgtagcggggagtccccacatacgatccagattacttccccagccggaggaataccagttgtcccggttggacatccggtgttcccatacgaaataaagcgtggagccgggcaagtattcccagcgggctaccaagttggaacgaaactcgttaaacctaaaatccgggttcctgaaaggcatctgcccagctccctccccgatggtatagactccatccgcataagttaaatgatccggatcaatacgttggaaacggttctcaaaggtatgcgacttcgtatccgccgctaatttaaaatcatcgtatttagcaatggaggtgaacggggcgccatagaattgaatggaaatatcgggggtcacgttcacttgtaatttcagcgtgaggccataggtcttctgatccatgtggcccatgacataataataaggggtcaagctactcgagctaagcggactcgtcgtagccacatattgcatctcatccgtattccacgcataatccagttgcccggacaaatagacatggtttcccaagcggaatgtcaagctcggcgagatcgtattgaagcgatttccctcgaaattatgatcgccctcgtatttgagcatgaacatcattcgtttcgccttatcggtattgaacttagcggaagttaagaaataagaaccgaagcgaacatccggtccccctcgcagcaagcggctatccagccaattccaagcgaaggtttccttgacatcccattcataccggttcatcgtcatactttgccaacgcaaggaagcgttgttgctaaaaggagtaccgccgtaattccacatattcttttgggacagggtaaaggcgttgtaccggaatatcttccagatatcggtctgccgatacatgatctccgtctcattcatcagataatctgtctccttcatatatcccatatcattcaagtcgaaaccgggtgacgaccaagtaaaggtctccgagaagttccatttggcgtttcctttccgtcccactttcacataaccacccgttccggtcagggagcgacgggtaggatccacccccagataatcggcggaggaagccctttgataataatgcgccacgctattctgcaaggccgtgatcgctccggcgctaccatgcaaggaactcaacattccctttacatctatataataaaggcgattcttgaaatactgggtaaaatcaatacccgccgtgaaagcgttacgcaccataaaatcttccagataaggctgatccaaggcacggtttaccgaagtcaccataccgcccagcaaggtattccccttccagttcttttgcacacgggccacggtatagtttgtcaaaggctccacgacttccacatcctccaccccattacgggtaaccttggaggaggaacgtgccgttacactctcgatcactccgatcgtcaagccccgtttattcgtacccgtcagtttcaaagcaccaataatcggcacattctctttcgtctcggcataactacctacgttgtctataccccgtggcgtataagagggagaggcgccgatcctacgggtataaaacatcatatcgctaccgttcgcaaaatccaagatatgttttccttccaagaagaaggggcgtttctcatcgtaaaacgtctcgtaagccgtaaggttcattacggagggatccaactccacttgtccgtaatccggattgatcgtcatatccaacgtataatccgagagggcgaacttagcgtccaagcccacgtttcctccccagctatgtcctttttgataagggctgccatctatccggggttcctgcctgtatttacccattacatacggcaagaactcgatgccgcgaggcttgggaacagagtccatgccgctcatgttaccgaacgaaaagacatgtccgttattcttcaaggggatcatgctccaattttgcacctcgttattcctacgtatgatacggcgtacgtgcaagccccaaacgccatcctccgattgctggttatagcgcaactggctgaacgggatacgcaactcggcggtccaactggaatccgcccgatcaatatgcgtccggccctcccaaacggcgttccagctcttattgacatccaacttgtcggtaacgattaaatcggtcttattccctcccagattgatattaaattccggcgccgcccgataatcatggtaggtatcgaaagcgacactgatcaaatcgcccagactattatcatcccggttcccgataaaacggttcatcttatccggtacggcgtccttacaatacacgcctatatagatatatttatcatcatagaaaagtttcacccgggtcggagattgggtgatcgcccgctcataggggataatctgtacgaaacgatccgaccattcgccttgcttcgtccaaaagtcctcatccagcttaccgtcaatcgtaggtttcactcccgatactttccggatattataggtacgcttataagctttctcaaaagggacgatcgaatcttgctgggcttcgcacaacaacgagattcctaaaaacacgagtagagtcagatatttcataatggtctagactataagataacaataagcctcaaagataagcacttcttttcagaaaagagcacatcttccttagatttatcgcaacgaagccgaaggcatacgatatcaagtactcactgcaccccgttttgcagtattaccgcgacgcacgtgcagcgctactgcaaccggcgtgcagtaacactgcaatgcgggttgcagtacaataacaatagcgtcacgataaaaatcaacaaccgcctcccaacgcccggtatagcaatatcttcttccggcataaatcggtgacgatatcgatatgctccagctcgctatccagataacgctcctcggcggaaagaacctccaagaaaccggtatagcttaattggaacatctctccggcattcaccacggaacgttggtgggcaagggattctttctctttcaagcggatacgctccgtttgggtctggctggcgcaatagagatcgagcacctcggtgtaagcgttcaaagcggtctcgtggtattgggataaagcgatacgctgggaagccttcgcctcgttccacatcgaacggatctcattgcggcggaagataggcgccgtgatacccgcagccaagtcgtacaccaaagaggccggcgaatgaaaccacttacccacatcaaacgcattgaaaccgccactggcgccaagcaccaacgagggatagaaagctgccttcgccgctatcacatccgccttggaggcgatcagccccatctcggcggaacgtacatccggacgcaatgtcaagaggtttgccggaatcccttccgacaagggaatcggcaacttacgcaactcatcgaatcccatccggcgaatctcgaaggggaaaacacccaacaggcaggcgatcgcccgctccttctcaccgatcaactgatcgttttccagcaacttactctcgatcgacagcacacgggcataaaactgatcgaccgccaactgcgtctccgccccttccttcttcaactggcgggtcagctcatgggaacgacgggcactggccagcgcgttccgcaacacctccttacgccggtccaagccgatcaactcataatattgaatcgccaaatcggagatcaacatcgactgggcaaaacgggtagcctccacggaagccatccagcgagcggcggcggcctgcttcttccgggtcagtttgccccagatatccgcttcccattgaaagctcaagctcaagccgaaatcccggtaagggtccggtatatgcttatcttttggcaaagaaggcacgttcgtctcgctattccccacaccatccatcgtatattcaccgaaacggttcacggaggctccgatgttcaaattcacgtccggcagcaaaagccctttcgcccgttgcaaggccgcacggctcatggcgatgcgctccatgctctgccggaaggaatggttattgcgtaaagccacatccacatagcctcgcaataaggtatcttggaaaaagacatcccacgacagcggtttcacgaacgtagtgtcgttcattcccatctcgccggattccggaagcgagatccgctcgtccatcgatagctcgggagtcttacaaccggccaaagcaatcagagccaaggcgcagcctatcattatatatctcatcttattaatacacatactcgtcttctttaatttgctctttctcttttctctttttaaaataagtagccagcgactcgaagatcacgtaaagccccgggatcaagaagataccgacaaacgtaccgatcaacatacctccggccgccgccgtaccgatcgaacgattacccaaggcaccggctcccgaggcgatcgtcaacgggatcaagccgctgataaaagcgaaggaggtcattaggatcgggcgcaaacgactggtagccccttgaatagcggcccccatcacgctgataccttccttacggcactggttcgccacctcgataatcaagatcgcgttctttcccagcaaaccaatcaacatcaccaacgccacctgcgcatagatgttattctccagccctaccacgtacagcaagaagaacgagccgaacacacccgccggaagcgacaggatgaccggaagcggaagcaataagctctcgtattgggcggcaagcaacagatagacgaatgccaaacaaatagcgaaaatcaccaatgtttgcccaccggactctttctcctccttcgccacaccggaccattcggtatcgtaaccacggggcaatacctcggaagcgatctcctcgacagcagccaaagcctcacccgagctgacacccggggcggcctcgccggtaatcatggccgaggtaaacaggttgtaacgggtaatctggctcgggccatacacacgctccatcgtcatgaagttggagtaaggcaccatattcccctccttattcttagcatacaggctgaacaaatcctccggattcatacgatactccggcgccgcttgcaacatgaccttgtacatctggccgaaacggacgaagttggaggagtagaagctacctacataggattgcaaggtttccatggactcgttcacgttgatgcctagcttagccgccttcgccaaatccacccggagcagatattgcgggaaattcgggttgaagccggaagtgacaccggtcaggcgaggatcagcgttcagcttcgccacgaagttcttggcaacctcatccagctcggcgaacgtaccggcggtcttatcttgcagacgaagctcgaagccactcgcgttaccgaatcccggaaccgtaggcggcaggaagaactggatgtccgcatccttgatatgggcgacacgatcggcgtacacgctcatcaactccgccgccgtctgctcccgttgatcccaaggggtcaggttaatcatacccataccgaagctggcaccctccgtctcggtcatcaagctatagccggccaaggtagagatcgtctccacctcttccaacggcaacaaagccgcttgcaccttgttcaaggcagcttccgaacgctccaaggtagctccgggaggtgcgtctacgttcacatagatcataccttggtcctcgttcgggataaagccggaaggcaacacgaacgtcatgccccacgtggccagacagaaaaggatcaaggtcgcatacgtcagcatccgacggttcaagaaccatcttaaattcaagcggtaacgacgctccaagaaatcataacggctattgaacccatcaaagaaacgagccagcagatttttcttttgcttcttcgagtgagataccggcttcagcaacaaggcgcaaagagccggagacaacgtcaaggcgttcacgccggagatcacgatcgccacagcgagcgtcaacgagaactggcgatagaagatacccaccgtaccatccatgaaaccaaccgggataaacacggcggacatcaccagcgtaatagcgataatcgcccctccgatctcaccgatcgcctttttcgtcgccttcaacgggggcagcttctcgttgtgcatcttcacgtggaccgcctctaccaccacgatcgcgttatccaccacgataccgatagcgagcaccaaggcgaacaaagtcagcatattgatcgagaaacccagcatctgcataaagaagaacgtaccgatcaacgataccggaacggcgatagcgggtatcagcgtagaccggaaatcctgcaagaaaagatacaccacgataaataccaagataaacgcctccagcaaggtcttgagcacgaccgatatggaagcgtccaagaaacgggatacgtcgtacgagatattatattccatacccggagcaaacgtcgtttctttcaattcttccatcttcgccttgatctgctggatcacctcacgggcgttcgagcccggacgctgcttgatcatgatagaggccgagggttttccgtccgtcatggagatcatattataatcctcggaatcaaactcgatcgtagccacgtctttcaggcgaagcacggaaccgtccggcagggctttcaagacgatctcgccatattcctccggcgtgctgaacttaccgctatattgcaagacgtattgcaattgctgcgggatcttgtcggagctgatacccgtcttacccggcgccgcctcgatattctgcgagcggatcgcctccgtaacctcttgcggcgacatattataagccgccaatcggttcgggttcagccatacacgcatcgcatagtcgcgactacccatgatctccacgaatcccacgccatcgatacgcttcaactcacgcaagatattgatatcggcaaagttatatacgaatttctccgtatgggtactatccgagctcatgatgttcaggtacatcaacatactgttcacctccttctccgtgatcacgccggcacggatcacctcttccggaagctcatccagcacggtggtcacacggttctgcacattcacggaagctacgtccgggtcggtaccgaccttgaaatagatcgtagtcaaggacataccgtcgttcgtacaaacagaggtcatataggtcattccgggcacgccgttgatggcacgctccaacggagtcgccaccgttttcgccatcacgtcggcgttcgctccggtataacgggcggtaacggtaacggaagggggcacgatatccgggaattgggtgatcggcaaagagttgatcgccagcaatcccaagaagacaattaccaccgagatcacgcccgataagatagggcgtctgataaatatttcaaacatagggcttacttattattctcgatttcgttagacgattccaattggcgacggatcgtggctccatctaccatatcgggattgatagtcatgccgtccgtgatcatctgaacaccctcgtagacgataacggtctggtccggcaaatcctgtgtcacgtaataagaaccgtggcgggccaacggctcgaagctacgtacgctcacctttccatcttccgctactgtatatacataggtgaaatcctgaatctcgaaagtggattgctgaggaaccaagacgacgttctccatcttggtcagcatccggattttaccggatacgccatgtcgcagcaaacgttccgggttcgcgaaacgggcacggaaagcgatcgatccggtaccccgctcaaagtcgccctccacggtctctaccttccctttataccgataggtggattggtcggaaaggatcagctccagattattatactccggctggtcgataccgctcaactgcgtccgtttatattccagatactccttctcgttgatcttgaaataagcgaacatatccgatacgtccgtcaaggaggtcaataagctgctcggcgtaaccaaacttcccaccttaaaggggatgcggtccacgtatccctcgaaaggagccgtgatcgtcgtgtacgagaaattagtctccgcacgttgcaaacgggatttggcctgttgcacctgcaagcgtgccacgtccgcctcggccatcgcctgctctagacggatcggcgagatgatatctttctccaccaaacgcttgatgcggtctacctctacctccgccatcttcaactcggcttgggcctgtttgtgattggcttgcgcctctttcacctcctcgtacaattccgccgaggaaagcttgaaaagcacctgccctttcttcacgtgctcgccctcgtccacaaggacggcctccacgaatccttccactttaggtttcacctctacaaactgtacggcttgtacatccgctacatacgactgcggcacctcgatcgtggtcgtggttaaccgcatcaccggcgtatgatctttcttcccggactttttctcccggttttggctacaagatacccatacacaagccgttaagcatagtaagggtaaatagttagaaaacaattttatcctcataaaacttatagatttataattatttgaatacgacgaaaagcacataggcgaatcaccccatgcgcaacaataagaaacaggtaagttctactaaatcagataggaacagaaccaaacgaaattctgtgctttgtgtaggttataaaataaaggaagcttggcgcattgccgtagttccaaggaatgaattaattcatgtaaatccagaatcgtaaacaagtcccatatcaaatcgatctccaaggctcgaatttgcacttgctcctgacgtaccgttcgcaaggaggcgttatcgtcaaaatccaacaacacatcgggtgcctctttatcgaccatttccatcgaggtagtggtaatattctccggaaagaaatcgcttccaatggaataaaactgtaacagcaccaacatgatcataagcatgatacgctggtgaagcccaaaacgattattcactgttacatttagcatcttttatctaatggaggcgcaaagataaacaatctttttgggaagaaaaaacatttcacccgcatacgagtattggtatcgccccacgccgatataggcatgaggcgatgccggtataggcgtagggctacaccaataccgacacaggctcacgcctataccggcacttaaatatatgcctttaccttctcccgatccgtttgcaccgtctcgaattcggaggagacgatactgcttcccatcgggacattctcattgcggtattccattttactatatacgatacttcgagcagaggtatgaaattctttcgcaccggtctcctcctctattttcccgatattattctcacgtacgccacatcccggcatgatgatgatccgtccgtccgcacgtttcaccagctcggcgatcaaggggattcctttcacggcatccgattgctggccggaggtcaagatacggtcgcatcccaactcgattagctgctccaacgcagtgaatgggtcccggcaaacatcgaaagcacgatgacaagttacggacagaggttttgccgcctcgatcaagcgccgcatcaagggtacatcgatatccccgtctttcgtaagacagccgaaaacgacgccatgcacttttagctccttgcacagttctatatccaatagcatggattgcacctcggcttccgtatacaagaaatcaccgcctctcggacggataatcacattgatatcgatcttggaagtcagagccttcgccgtcttgatctctccataactaggtgtagttcccccttcgggtatcccggcgcaaagctctacacgggtagcgcctcccgcctccgcctccacacagctctgggcggagttcgcgcatatctcaataattcgtttcatgtttatttagtattgttgacgtacaaaattacataaatatcaccacttgctcaacagaaccacaaataactatccgataccattaaaaacacccctattatggattaacaaaataaaacagaactgtcacctttactatcaaaaaggcagcaaattcgtatctccttatctatctatgccttagaaatttgactatagctttctgattcgtccaaataagaaacaaattggtctatttcggaactatagctaaatagtttaaagtttaactaatctcaaaaagacacaaaaagttctattttcaaggatcgaaacgccataaaacgtaatattgcaacgacattttaataggttaagataaataacaaataggctttatgggagaaataaaaggctatatctcacaggttatcggcccggtagtggatatccactttgattatgggacagaagaaacagtaaccctcccccgtatccacgacgccatggagatttcccgctcgaacggaaagatcttgatcgtcgaagttcagcaacacatcggggaaaacaccgtccgtaccgtagcgatggatacgaccgacggattgagacgaggcatggaggccatgtcatacggaatgcccatcaccatgccgaccggcgaccaagtcaaaggacgtttaatgaatgtcactggcgaccctatcgacggcatggcccagcttactaaagacggggctcttcccatccatcgtgagcctcctaaattcgaggatctgacaacgacccaagaggtcttgtacacgggtattaaagtaatcgatttattggaaccttacgccaaaggaggtaagatcggacttttcggaggagccggagtgggcaaaacggtattgatcatggaattgatcaacaacatcgcaaagaaaaacaacggattctccgtcttcgccggtgtgggtgaacgtacacgtgaaggaaatgacctattgcgtgaaatgatccaatccggtgtcatccgatacggcgaggagtttaagaagagtatggaggcaggcaactgggacttgtcgaagatcgattacgatgaattggctaagtcgcaagctaccttggtattcgggcagatgaacgaaccgccgggcgcccgctcgtccgtagccttatccggtttgacgatcgccgaatccttccgtgacaaagcctctgagggagaaagaaaagatatattattcttcatcgataatatcttccgtttcacccaagccggttccgaggtttccgccttgctggggcgtatgccttccgccgtaggttaccaaccgacattggccacggaaatgggagctatgcaagagcgtatcacttcaaccaagaagggctccatcacctccgtacaggcggtgtatgttcctgccgatgacttgacggacccggctccggcgactacctttacgcacttggacgcaacaaccgtcctcagccgcaagatcacggaactcggtatctatccggccgtagacccgctggaatctacatcccgcatccttgatccgctgatcgtaggcaaggagcattacgacacagcgcaacgggtaaaacaaatcctgcaacggaacaaggaacttcaagatatcatatccatcctcggtatggaagaactttccgacgaggacaggctaacggtcaaccgggcccgccgtgtacaacgttttctgtcccagcccttctccgtggcggaacaattcactggcgtacccggtgtcatggtctctatagaggatacgatccggggattcaagatgatcatggacggggaaacggatgacatacccgaacaggcattcttaaacgtaggaaccatcgaggatgtcttggagaaggccaagcagctgaaagaacaagcaaattaatcgatatgaaactggaaattgtatcaccggacggcattcttttcgaaggcgagaccgaatctgtctcattcccgggagttgccggttcattcgatatcttgcctcatcacgccccattgatagcagcgttgaaggcgggtacgatccggttcgaggcaaacggcaaaagacaagaacaaacgatacaaagcggattcgtagaggtaaaagacgacatcctatccgtttgcgtcgaataaaaacatacgacaatgaatggcagattaaaaatgaggttaatgggtttgatcacgtttatcaacgtggcaataggcgtttcattgggtggtttattatataccatctggccggaacactatttctcgtggtatccgtccattcccttcttttactgggtcatggccatggcgatgactttcttcctagaccgggtaaaaaggaaaaacggagatgtgaccgtaaccatgtacatgcaagtccggttgtgtaagttcacgctcgctttcgtcttcttatggatgtacgcggcgtttgtcgggcaacaattaaagacatttggtttcacgttgatgttattctatttcatttacctcggactggagacttacattttatatctgtttgaaaagaaaagaatgaaaagagagaaaagggaaaaggatgatgagtacaatcaaagataacaaatacatatggatcgctttctggatgtggctcagctttctcaccccggcaaaagcggcgtccggcgagatagacgtgcaggatatcgtcttctcccacattcaagacgcctatacatggcatatcacggaatggaacggacaagagattgcgattcccctgcctatcttggtaaaaagcgaggaaagaggatgggatttattcctgtcatcccatctacatcaaggccggacgcatcacaattattatatcgccggggaaggtgagcatgcgggaaaggttgttgagaagaacagtgccggagaagaggttcgcccgatggatttctcattgaccaagaatgtttgcggactgttcctcagttgcggtctcttgcttttcatcgttctccgaaccgcccattggtataaaaagcacccgaacgaggcgccgggcggatttatcggattgatggaaatggccatctcctacatacaagacggggtgatcaaagaggcgatcggaaaagaatataagccgttctcgtcctatttgctgacggtatttttctttatcttgatcaacaacctgatcggaatcatacctattttcccgggaggcgctaatattacgggaaatatagcggtaacaggcgtattggcactttatacgtttatagcggtcaacctgttcgccacgaaagcgtactggaaagagatcttttggcccaaagcgccgatctacttgaaactgcccttgccgatcatgccgttcgtggagttcttcggggtattcaccaagccgttcgcgttgatgatccgtctgttcgccaacatcatggcgggccatacgattatcttggcgctaacctgtttgatattcataacggcaaccatgggagtagccgtgaatttcggtatgacgatcgtatccgtcttgttctgtgcgttcatgaactgtctggaattgttagtagcttgcttgcaagcttatattttcaccctgctgtcggccaactatatcggattggccaaggtaagggaataaatccaaagaaattaaggtattagaattatattattaaggttactaatttaaaattaaacactatgttatcgactattttattacaagcggcagccgggatgggcgtagcgaagatgggagccactataggagcgggattcgccgccataggtgcaggtatcggaatcggattgatcggtaaaggtgccgttgaagctattggacgccagccgtcggccgcaggagagatccgtacctcgatgttgattatgggagcgttggtagaaggtgtggcattgttcgctattgtcgtatgtttcttagcgttgttccaataaaaaagtaacaaactatgtctttattaacaccggattcagggcttctattctggatgatcgtttcattcgggattgtcttcgtgatcctttccaaatacggttttcccgtgatcgtcaaggcaatcgaacaacggaaagcttacattgacaattccttagagacggcacgtcaggcgaatgagcgacttgcccatatccaagccgagggcgagaagatgctagccgaggccaaggaaaagcaaaacgccgtcctgaaggaagcctttgccgaaaaggagcggatcatcgaggaggcacgtaaaaaggccgtctccgaggcacatctgcagatagaggaggctacccggcgtatccgcgaagaaaaagagaaagctattcgcgaagtccgctcggagatagcggatctgtctatcgctatcgcagagaaagtaatgaaagagaaaatcggccgggataaggaacaacaacagatgatcgaccggctgctggatgaagtatcgtttagtaaatcgtaaggtatggatataggaactatttcttcccggtatgccaaggcgcttttctccctagcgaaagacaagggacaggaaagccgggtatatgatgatatgaagatgttggcggacagcttctcgatggagccggagcttaggggtgccttgagcaacccgatcgtttccgtaccggagaaagtgaaattgcttacggcggcggggggtatcgaggtctgcgagctatatacacgttttatcaatctggtattagcccataaacgggagacactactgcccttcatcgcatacatttatatccatttgtaccggaaagagaagaagattacccgggtacgattcgacacagccgtaacggtagacgatgcggtcaagtctcacctgcaagacaagctgcagaaagagacgggatgcacgatcgagttctccggccatgtggaaccggaactaatcgggggcttccgcctacgcatcggcaattaccggatagacgccagctatgcgacgcaactacgggatatccgtaccgggctactccaaaacagataaaaaagaaaaagtatgacagaacagataaaagtgagtgaagtctcctccatcctgcgccagcaattagaaggaatccataccagcatcaagctggaggaggtcgggaccgtattgcaggtgagtgacggcgtggcccgcatctacgggctggataatgcggaggcgaacgagttgcttcaattcgataacgggatggaagcgatcgtgatgaacttggaggaagataatgtaggcgccgtccttttaggtccgaccgaccgaatcaaggagggcgacaccgtaaaacgcacgggccgcatcgcctctatcgatgtcagcgaggggatgatcgggcgtgtgatcgacccgttgggaaacccgatcgacgggaaaggcgagatccttggtgagacttgcgagatgccgcttgagcgcaaggctccgggcgtgatcttccgtcagccggtaaacgagcctttgcaaaccggtatcaaggccgtagacgctatgatccctatcggaaggggacaacgtgagttgatcatcggcgaccggcagacgggaaagacctcgatcgctatcgataccatcatcaaccaacgtagcaactacgaggcagggaacccggtttactgtatttacgtggcgatcgggcaaaagggttccacggtagcggccttggtgaacaccttgcaagagaaaggcgccatggactatacgattgtcgtaagtgcgaccgcctccgacccggcagccatgcaatatttcgccccgttcgccggagcggccatcggagagtacttccgggatagcggacgacacgccttggtggtctacgacgatctgtccaagcaagcggtcgcctaccgtgaggtttccttaatccttcgccgcccttccgggcgtgaggcgtacccgggtgatatcttttacctgcactcccgcctattggaacgtgccgccaagatcatcaaccagccggaggtagcccgtgagatgaacgatctccccgaaagcatgagagacaaggtgaaaggcggtggctccttgaccgctttaccgatcatcgagactcaggcgggagacgtatcggcttatatcccgaccaacgtgatctctatcaccgacggacagatattccttgagaccgatttattcaaccaagggaaccgcccggctatcaatgtcggaatctccgtttcccgtgtaggcggtaacgcacaattaaaggcgatgaaaaaggtagcgggtaccttgaaaatcgatcaggctcagttccgtgaattggaatcattttccaagttcgggggcgagatggatgccgtcaccgctttcacgatcgataaggggcagaagaatacccagttactgatacagcctcaatatagcccgatgccggtggaagagcaaatctcgatcctttattgcggaacgcaaggtctgctgaaagaggttccattggacaaggtgcatgagttcgaggcaaggttcttgcaagaattacggacttctcatcaacgggacgtactggatgtcttaaagaccggcgttatcaatgatgagatacgaggcatattggaaaaaacagcgaaggagctatgggttcattgaaagaaataaaagtccggatcgcctctatacggagtacgcagaagatcaccgccgccatgaaaatggtatcgtcggccaagtttcatcatgcccagacgcaaaccgagcacacacttacatatgctaataaactatccgctatcttaaacggtcttctttcggcggaatgcgacctagactcaccttacaccgaacagcgtaaggtgagcaaggtggctatcgccgtattcgcctcgagcacgggtttatgcgggacattcaatgccaatatatggaaagagttatccgccacgatccagacttataagaaccagcaaatagaggtaggcctctaccctatcggcaagaaaatagcggatgagcttcataaagcggggtatagcttcgacactgatttcgtcacgatcggcgaaaagccgtcttatgaaagcgccgtatccttggcgaaccgtctcatggagctgttcgtcacgggtaaagcggaccgggtggaattactgtatcaccatttcaagaacatggcgacacaagtcgtaacccacaagacgtatcttcccctttccctctcggatacggaagcggcggaaacggccaccgactacatccttgagccctcggcggaagagttgcgtaaccggcttttcccgaaattgctgaacctaaccatctatacgatcctactcgacacctcgaccgccgagcacgccgcccgtatgatggctatgcagaccgccaacgacaatgcgaacgatttaatccaacaattaactttgcaatataataaaacccgccagcaagccatcaccaacgaattgctggatatcatgggaggagcggccgtttcatcgtaataaaaacgggatgcttccttgactaaacagacaatgatccgtatgtaaaacactttactaacggatcatttcttatttacaaaaaaaagtaagacctttgctcaccaaaacataagcctatatacattatattataccaatctaggatcgtactcatgatgaatcaagaaaagctaaaagggcatctccttattttagcggccaacatcctgttcgccattaatatgcccgtatccaaatatctactccccgagcatgtgcaacccgaggcgttaaccagtatgcggatgagcttcgcttgcgtgatgttctggatcacctccctattcgttccctatgagaaagtgccgttgaaagacttgggacttctatgcctttgcgccctttgcggagtaggcttgaaccaagggctgtttatctggggattgaataccacgtcgccggtagacgcttccatcatagcgaccgccgtccccatctttgtcatgatcttggcggccctgatcctaaaggaacctatcacacggatgaaaacgttcggggtactgcttggtatatgcggggcgatctccttaatactacaatccacgcaaggttccaatcaagcgagcagtctagggggaaacctcttgattacggttagcggattcatgtactcgatctatttggtagtatccaagccactaacactcaagtactcatccgtcacgatgatgaaatggatgttcctgttctccacgctgattaccctgcctttcgctatcgagtccatctggaataccccggctttccataaagaggtcttcgacggccaagagctgggagccattttcttcgtattattcggggccacgttcataccctatttattaataccgctggccttaaagcgaatccgcccgactaccgtcagcatgtacaattatatccaaccgatcgtagcttcctttatcgccgtattcatcggtcaggatagttttagcgtaacgaaactagtatcggccgcacttgttttctccggcgtctatttagtgacccaaagcaagagccgggcggaccttgaacaacaaaatagtcaatcttttagcaaaaacgcttgcaatatgaaaaataatgcgtaatattgcccccataatataaaagaataagtagcatacaaaatcaatgatgagtgtagagtcctcatattatacatgggcattgatgaccccttggggggttagaatctattaataagcattcgcgtagaccacgtcacgctatgtcgcaatctcgtattgcatccttttttatttctccttttacataaataagtttaatcaatcggttattgtcggttgttaatcatgaaaaagccttttcttgattgtcaatcctcgatgaaccattaaaaatacatatcgatgaaagtattaaaattcggcggaacatccgtaggttccgtgaatagtatcttaagtgtaaagaaaatagtagaggctatcgaagagcccgtaatcgtggttgtctccgccttagggggcatcaccgataaattactggccacttctaccatggcttctaaaggcgaccttgcctacgagaaagaattatcggagatcatcgcccgccatctggacgtgatcgagggagtgatagaggacaaggaggtacgcatagatgtccagaagaaagtgatggctttactggatgaattgagcaatattttttagtattaatattaatccaactcccgcctgttcatccgtcacggattacttgggatcgaaaccctcacgggaattgttgattatcttatttcattattcctttattgaatatccttattttacagctactttcactgtctcgttacctaccgttacgaatactacaccagcaggggcggcgatagtagcgttgtcggaagtaagaactgtctcagcaactgtctggcctaatacagtacgaacgtaagcagtctcgcctgcggcaccttggatagttacgacaccgttaccggctacaactacgatagaagattcttttgcgtcgatagattcgttggctgtcggaacctctgtgccaagcgtgaagaccattgctttttctggatctgttgttaaacctaacataccattcaaagcatatacataagctgtcttataaacatcaccctctttgacctttctctgagaagaaacgaaatattcatcatctccctccgcaagtgtgatattaaacttgaacgcatccaatcgatctgttgatttcacgctcttgtcatcgttaagctccttaacaaccttaacggtctcacctttcacggtagtagtgattgtatcaacccccgtaaggatagccgggcggaagataaccttcgtctcagacttgcttgaaccttccaaataatatttctcgtccgtatattcttgagcagaaccttccacgaaataatgcaaagaatctgtcggattgaacatgaacattctttcagccggtttttcctcaccttcagccacctcaatacccttagagatatagaatgacggagtcttagccttgctatccgctgtatccaaccagaagatcatgctttcagcggacaagatgccctcgttgaagccattcttattcaactgataattgatagaacctaacatattgtcgaaagaagcgtgacgaggtttagcggccaatgacgggttgaacggattagcgtccaaaacctcaacgttagcgtaagcctcattcaaggctttagctgccatataacgaccaccatcgaaagaaaccttcaaatctgttgttccgatttttgctgttttcgcatttggaccagtggaaccctcataactaagcttaccgtctgttacatccttcactgcaactaaagaataaccaccagcggcattcttaacaacagcgaactctgtagcctcatcagcagccttatctctagatgcggcagcgccaagatatttagcatcatcacctttagcctccgtataacggaagacataagtcggaacaaccaatgtatcgccatcagccttcatgataacctcacccttatcattcaaataagcgaaagtatttgtgcttatcacataatcctcaacaccttgcagagatttagtagaatgatcttttgctccctttattctttccggataaagaacgattaaattctcctctttggttgaagccttcattgttttagtatcattgtcatcaatagcgtaaagagctttctctccgaataacgcgtccttaccattgaatgtcatcttaaagccttcagcgatctgagtatccgtgaataccttatatccgtccgtacgagtcgtagcgatcgtgttgaacttaacggaagtcttgttcagcgctaaatcatccgttacaccattagatgcgctagtctcatctccagagattgttacgtcctctccgtcataagttgctttctctaccttatatccaccttcttctccattaggctgcaagcgcaataccaactctttagcagtctcacggtttttcaatgtaaatgtgtatttaccatcaaaaccagcgacaatccattgagctaccggcatagtgaagtccacgttattataagcggcaacacttagatctgaaccattagcaggatttatggtcaaatatttatgatactctgtctgaataccaggcttatcttctttactcgtagtagcactagtgaagtagatattaaccacattctcaacattcttcttcaacaatactgaagcgttaagataagaatttgagcctaattgcgggtgaataggggtataattcgtttttgtactttctcctgataacacagtagtcacataagtcttcgtatcagaaacagaaggtctaacggccgctacatatacctctgtaccagccgcagcctcatccaccttgaaagtgactttcaaagttaatttaccttcctcattcaatgcatctttcgcagtaatagtgaaagcagcattggctgtagagtcagcggatgtcgcaacagcacccttcatccaatacaaagaataaccttcgttatcttgcttaccattgatatcataacgagatttcggattcgggttaacagccaagaatttaacatcttgagcagcagccaagatatcgttagcaactggagtctcagcattaaccttacctaagaaagcatcaaccttcttagaatcaccacttacgaaataagtaccagcagccaacttagcctcgcctgcaccagtctctgcaatctcatcagagaaagtcaccggctttaccttatcaaacaagtttccaaccaactcatttgtcttataatcgaaagataatgttgtgccagtcgaattatagtcattcaaataatcagcattgacttttccttcatacgagaatgctttcaaatcggttttcacctgatttgtaggcactgtaaccgtatacaaacctttaaaattcaacttagcagtcgccgtagtaaattttgtttgcaaatcggaaagttttttgtctgacgcagaagtcaagtcctttccatctgtagcaacagccacttgatattccttaccatcaacattcgcccacaactcaaaagagctagaggaataattgcggatcgtaaatacagttgcatcagctacttctgaagccgtagtactttcgaaagaaacaacctctttaccatccttcgttttgagggcatccgttacctttaataaggtagtcttagacgcacctaaatagaaactcaagccattagcaagagctgtcttattctcgctataggagatcacggtcttatccgtaagatcgacatcagcggcatacgcagcattaaaagcaggtccacctagcagtaaaccagctgttaacaaggtaaaaatccttttgttcataaattcaaaatttaatattaataatagtgttaattaaagtccatccccgggtcacctgcccatcagcgaggactatcggctgacgatggtgcgacagcaggcgatggcgtggttgctgcggaggtatttcgatgggccgataacagaagagaaagcaaaacgaaccatctcctttggagattaagaaataaaacatacacattgttaatttaatgcaaaatcataaatataatactttttcaagccaataaataataattaaatcatatctttggaaaaaagataaaataaaattacaagtcatgctctaacagccttcatgtttctataaaatgtaagactgaatctaaactagccaaaccaacttctactttttagtaaagcgtatggttttctatttctaataataaagatattaaattaacattctatttatgaaaatcattattttgcaattcatggcaataatcgctatgatccttataagttgtaacgataaggaaaacagcgtgtacctaaaaaatggttcctactcggaatgcgccacggggaaaaacttgaccaaggcgcaagaagagaccgcttatgtagaaatcagtgcagttaacacaaacactctaagagtggacatgtaccatgtccaactgaattgcgctctggaaaaaatagagtcgagtatcagttataatgaaaaagtaatcataattaaattcacgccaattggcgatgatgctaattgtctttgtggaagacaattaacatatgaaatcagcaaccttcaagaagggcagtcttatgattgtgtgatcatgcaagagaatagtgaatatgcctcttttaaatttgatttcacaagagatctaacacaaacaattaatctaaattaaattacgacattatgaaaaaaatgtattttatcatcatttatgtgcttctactatctataggagccataaacagcgcaaataaatccataactaaactcgaagcttataatatagttattagtggcattgattcgactacattagattccactgaaatatttgtatccaagcagatattaccagccaacacagtcattgagattggtgataaaagtatagaatccccggattatggctcttggatgtttttcataaataagtatcctttatccaattggggacactcttgtaactatatgtttatcggaagtaacaatggtgaagtagatataatagagagtaatttctaccctactaaaccatcattggctgatatggataaaataaagtctagcgtagttacatttgatgagtctgtttttgtcaagcctatggcaaggcctcagctccttcaaacaaaggcaacatatgatagcaacaaatatgcagtaataattagtggaggaggaaatccctctgtcaattacccgagatattggaacgattgctcttctatttatcagacattgctttatacgtataattatgaccctgcccatattaccgttataatgtcagatggaacgagcagcaacatcgatagaagcactggcgattcttcgccgttagatttagacggaaatggaacaaacgatatacaatttgcggcgacaagcaataatatcaagactacttttagcaatcttgcgtcgaggcttacctccaacgactatctttttattttcacaatagatcacggaaattatgactcttccgggaactctagtttaacattatggaacgatgagaatttgtatgcatcaactttcgctccttgggtgaatgccattaatgccaaagcgatcaatatcgtaatgggacaatgtttcagtggcggttttatctcttattttaaaaataatccaaaggtttccatatcaacggcttccactaaagatcagccatcttcttccatgagtgacggccgttacgatgaattcgtttactattggacggaggctgtcacgaagaaagcttcttctggatatatggtaggagatgttaaccaagacgcttttacaacagctcatgaagcatatgattacgcaaggactcatgataagaaaaatgaagatccacaacactattcttcggatttactctctcattttttagccctaaatgggatgagagcaagaactacgagcggaacgattgcagtagaacgtggagagacatttaattattccggtatggaaactatcaactggactattcccttaaattcacctgtaaatatatcaatcaaattcccaacgaatatagtgtacaaatggaattgcagcagtggaaatcccggtaatttttattcttcatcatctacaacagcctctgtgttagcaaattcaagtagcacatcgcctattgtcattacagctaaagctgatggctccactttaacgcagacattccgcctatatctaaaaaacacctatagcatcatgaatgacaattcatctatactaaatatcaatttagagaatcaagaaactaacaatctattaagtaagtcgcaagactcttatgaaatatactctattaatggaacaaaatgtaagtctggattactaaatagatacaattccatagatatatcttctctggcgaatggaatgtactttgttacgattcataattcgaattcgatcttgcaaaaagagcaattcatcgttaatcattgagaaataagaagactatccgagccgggtaagaaattctctttacccgacccatttcaatcagtccttgcaagagcggggattgatacacgatacccccgaggagaaacgccacgccatgagcctcttcgcccattggagaccaccgggacggtacaggtgagcctgttattggcgctaacgtggtggtgaaaggcactacaaacggtacgatcactgatttcgatggaaattatacgatcgagggtgtgcccgccgacggagttttggtgatttcctatattggttatttatctcaagagatccctgtaggcaaccaatctgcaatcaatgttacattgaaagaagatacacagactttggatgaggtagtagtagtaggttacggtacgatgcgtaaatcggatgtaacaggttctatttctacagctaaaggagaagagatgttaaaagctcaaaactttagtgcattggataacttgcgtggtaaggctgccggtgtaaatatcttctctaactctagccagccgggtgcttatggtagccgtgttgttatccgtggtcaagcgacaattaatgcctcttctgatccgttgtatgttgtggacggcgtagtaatggagaacttctatttgatgaacccgaatgacatcgagtctatggaggtattgaaagatgcttccgctaccgctatctatggtgctcgtggtgccaatggtgttatcatggttactacgaaacgtggtaacaaagaaggtggaacgaaggttagctactctggttctgtaagcttggctcatcgcgctcgtaagatggatacgatgaatgcgcaggagtggtgcgatgcttttatgcaaggtattgagaatgagaatagatggggatctgataaggatggcaatccatttaactggtctactaatcgtgcggattggtttacagatcgtcgtttcttcgattctaacggtaatcctctttatgatacagattggcaagatgaggcaactcgtacagcgatctctcataaccatcaattgaatgttcagcaaggtggcgagaaatcatctatgggtgcatttttgaactatactgataaccaaggtatcatgttgaatacctattcaaaacgtttgaatgcaaagatcgcttatgatgcgaatcctacaacatggttatctacagcgatcaacttggcggtgaaccatacttggggtaactctactccagaagacggtggtggacaggatgctcgtcgtactatgattgaaatggttccttggatgccggttcaatataatggcaaatatacctccaccaatactccagaagggatgccaatggactttgaggcaatgtctaaccctgttcatatcttgaagacctataagaatatgaactataatacaaaagtattcggtaatgcagccttgacattccatatcatcgaaggtttggatttgaagactcaattcggtgttgacgctaactttaagactttgcataaatatatgccaagtgacttggtgaatttggcatatgaccaacatggacgtgctgaaagatatcatgcaaatactctttattggcaggaagagacttacttgacttataataagacgattggcgagcaccgtatcaacgctatggccggtttgtcttggcaggagcgcaagtatgattattctagaatgtatacagaaaacttcactaccgatttctttgaggacttcaatatggacgcaggtacgaagcctgatgctccgaagacttattgggaacgttgggctatgaactcctatttcttacgtttcgcttatacattcaaggatcgttactccgctacaattactggtcgttatgacggttcttctaagtttggtaagaataataaatatgcgttcttcccatcagcgggtttggcttggaacatcacgcaagaagactttatgtctgatcaaaatacgatcagcaacttgaagttgcataccagctacggtttgactggtaactctgagattggtgtttacaaatctttagcaacagttaagagcgaaacgttattattgaacggaacacgtaattcctattcttatttaaatagattgcctaactctgatctgaaatgggagaaaaccgcccagttcgatataggtttcgatttaggtttgttcaataatagaattacgttagatgcttcttattacaacaagaagacttctgatctgttattggatgctccggttcctcatacaacaggtttcgagactgtttataagaatatcggttctatccgtaaccaaggtttggatctgatgttatctactcgcaatattgatacaaaagacttcacatggacaacatccatcaatgctaacttcaataaaaataagatcttatctttgggtgacaatgacgaggatatcttgaaaaacgaatgggtgagcggtgcttctatcttgcgtgtaggcgaaagcgtaggtagtttctatggttacaaacgtttaggcgtttatacaatagaagattatgaagctggtaactgccagaagaaacagatcggtcgtgcgaaacgttcttctgagcgtgagatcataggtaaaggtgtacccgattggactggatctatgatcaatacattacgttacaagaattgggatttcactttggatttacaatttgtcgctggtgttcagaccttgcaacagttctatcactctacatatgaccgtttcggacagactaacggcttgacaaatatcttgtatgacgcatataatggaacgaatcctaattctatgcagcaagctatctggttgttcaacggtggtcacgcaggacaggatactttgacagactctcaatgggtggctaatggttcttatttacgtgcgaacttaatccagttaggttatacttttgactcaaatcaattggcaaagactccgtttagtagcttacgcctatatttgaatgtgaacaatgcgttcttgattacagcgaaagactttaatgggtacgatcctgaaagtacatctcagatctctacatctaacggttcagtatctccagaacaatttggtcagaatatggccttcttctcttatccgagagctagaacgtttacgttgggtgtaaatgtaatattttaattaattaaattattcagaaaattgcaatgaaaaaaatattaacaacagctattttatgtgcgggattggtaggatttaccgcatgtgacagttttttggatgaggatccgaagtcgtccttgactttggatacctattataagacaagtgctgatattattggcaatgtcaattatctatatcgtgatggtgctcctgataagatgggtaatatgactggtgcttatagaggttctagcttgtctgtaatgaacatggtaactggttatttcgtgaatgaatatgaaggtcaggaagtagactgttcctatgctcgccagttgactcgtcaggactttacgcaatcttgttgtaattatttgactaatgacacttggaaaagttgttataagtcgatcaatgtagcgaacgcagttatcaagtatgttgatggtgtggaaatggataatcaagctcagtataaagcagaggctcgtttcttccgtgcattgaactatttctatcttgtaaaaatgtttggtgatgttccaatggttacagaacctacagaagatgctactttggttgaatatccgactcgtacggctgcatcggaagttttcaatacagttatcattcctgatttacagtttgctgtagagaatttacctaatgctacttttgcaggaaatagtcaccgtgtgacaaaatatgcggctgatatgttgctggccgatgtttacatgagactaggagagtacgctaatgcggttactccattgaaagatgtaatcaatagcggaaaattcgctttggctactaacgataaccttgcggaaggtagtgcgttcaataagttacgtacaacagatgatctgccagaggttatttatgcccgtgaatatgacgcagctatttctcctaacggtaatatcccggttcacgcattcaatttgatttctccgacattcttcgctaattcttctactggaaacaaatactctttgtgggtaaatgtgtatggtgttagcgagcgttatttgaatgtgtatggtgagaaagacttgcgtgcccagatgaatcagttcttccatcgtacatatacgcatcctgttgatggaacaactctggatatgaagatgctttgtaactggtactggtatgatgagactgctatcttagagactggtaagggtacgaaagactggaacttctatcgttatgctgaaacattattatctgccgctgaagctatcgctcagtctagtggggtaaacgctgaggctgccggctatttggcacaagttaaggcacgtgctaacatggaaggtaaggatgtttctacaatcgcttccgagcttcaaagattaggcaagcaagcttttattgaagagtgctggaaagagcgtttacgtgagttcccattggaaatgaagatttgggatgactgtgttcgtacaggtaaattccctcaaatctccgctacaaacaaaggtgaggttcaattcgttgatttaattggcgctaagaatggtagcggtgctacattcaaggcaacagacttatactggccgatccctgtaaacgagatccaacgtaatccgaatttaactcagaatgagggatattcagcgaagtaattactttttatttcaataactgatggctgaaagggaaggatgagtgattattcttccctttcttccttaatacaagaaccccatcatccataacgggatcttatttttatatcatccgcaacgataaaaccgtccggtatcccttctattggtgagtacctttttcgtttgccaccgatctcgaacgtataaattccatccactaaaaaatcgttggcttcgctcatactttacaaatttatcctttctattttatctgtaatactcggatgtaaatctaaggttgttacttggtgagactttttcaattggttcgcaaagaacgtctcccgcatgttgccgatattcgctttcaaaggcgagaggatatacatcagatttctatttttcaagtagatattgtccggcttttgcaggcgagagataccaaaagtagaaacagttgtaggtcagcttactttctgccaatacgtttagataagtcaataaaacgtttctcgtgatactaatccattcgcagagcttactgatattcgggataaaaggggccggtaaagataatttgcagttctggcatatcatcgtatatattcttcaactcttggctttactggggggatttatgtacctcatccaagtgtaagcgtgttcctcctcgtttcacgaaacgatccgcaaagtcatataatgtattgtcagagaaatagatactatctaagctgacatatatggttcgttcgtcttgcggaaaatttcgcttgatatgctgttgcggtacactccccgagcacctcttataccgatcaaccgggcatcccgattaatctcgtacaccgtgcttctaataaaggcggtagaggtaaatcgcaacttctttcgatacatctctatcaatcgctccataatcgtacttatatatatgcaaatataacaaattgtttatagcagagagcaattttgggcgttttttgtttacagaaggaagcaattgcttatcctctagcctgtgtcaaagtaaaggatgtttatgaagtactagtgacttggcaaagtaatatatactgcgtgggcaaaataagtatatatcctttgagtaagtcagtagtactgctcagaaaatcattcttttttcttcaccttccaaccgtccttctaacttagcagaatccagtatgtcatttcttgctcttttgttttcatagttgaaagtgaataataagacaaccaaaccaaaattctgtatattatacattgtttcatgcaacttgctgactaatcaagctaccaaaaagagagggaaggatgatcgctcattccctccctctctagccatcagttattgaaatttattattgaacggcataaccctcattttgagtcaaactcgggttacgttgcatctcgttcaaagagatcggccataacaagtcggaagacttgaaggtcgcgccggaagcgttctttgcgccaactaagtcaacgtatgtaaccttacccttctctgtagaagagattacagggaacttacctgtacgcaaacagtcatcccaaatcttgaattccaacgggaactcacgcaaacgctctgtccagcattcctcgataaaggcctgcttacctaatttctgaagatcggcagtaattgcggctaccgtcttaccttccatgtttgcacgagccttaacttgtgccaaatagccggcagcctcagctgttacaccttgagactgagcgatagattcagcagcgtcaagcaaagcctctgcgtaacggaagatatcacggtctttcgtagaacgtcctgtgttcaacaaagcgtcctcatcataccagaaccagcaaccacaagcattctcaggagccgtccaagtcttgccattatccggatttgtataattccaatggaagaattgatttggctggatacgtaagtcgtttgccgcatacacgttcaagaattgattcgttggcccgtatgtacgctcaaagatagaatacgtaccaaatatagctgtagccgctgagttgaacgcataagtaggccaccaaccaccgttactgatcgttgcgttgtactcataagaatagatagactcagccaaaccgtctgtcgtacggatcttattataggcagaacccaatgctaaatcatcgttggttgccaaagcatgcggagaatcgatcaccgtctttaccgcagaagcagcgtcggcatacttaccttgttgcatataaacggaagtcaaaaccatagcggcagcatacttcgtgatacggttactattgttgtagaaagtagcagccggcaaagcattaacggcatccttcaagtcggattcgacctgagcatatacttgctctacagaagcacgctccaaatacatgttctccatagattcgtacggctctactgtcaatggaacaccaccaaagatcttcaccaagttgaagtagttccaagctctaaagaactttgcctcaccgatcaaacgatttgccaaagactgatccattgagatctcggggatatacttgatagcgccattagctacgttgatagccttgtagcaatcatcccatataccgtcaatagttacggaaacagtcatcgtattctgctgacgagtcaactcgcgagaatatttacaagtcagctcctgaccttcataactgtttgtaaagtaaccggtcaattgtcctgtgatagaggcaaacggacctacgtaagcactacccgcacctgtgagcttacttgaagctcccgtacgatacaaatagttcacgttagcctgagcttgagcctctgtctggtaataatccggggctgtcaacgatgacttcggtttctcttccaagaaatcattacatgcgctgaacccggttaaacaagcgcatgcaatcgctactgtcaatatttttttcatttctaaaaattctactgattaaatgaattaaaatgttacattaacaccgaacgtgaaagttctcgctcttggataagagaagaataccatgttctgaccgaacttattactatcaccctgcgatgtaccctcaggatcgtaacctgtgaaatcgctagcagtaatcaagaataagttattcgcacttgcgtacaaacgcaaagcagacaaaccgatcttgctaatcacgtttgagtcaaaagtataacccaattgcaacatgttacaacgcaagtaagaaccattggcgatccattgagaatctactgtcgtatcctgacctgcatggcctgagttacacaagtaaacagcctgttgcatcgtgttcgggttcgatccgttatatgcgtcatataaaatattgctcaaaccattcgtgataccgaaacggtcgtaagtagagtggtagaactgttgcatggtctcaacaccccatacgaactgcaagtccatcgtcaaatcgaagtttttgtaagagaagttgttgatccagcttccagtccagtccggcatacctttgccgatgatctctttcttatccgtacgtttcgcacgaccgatctggttcttctcgcacaagccgttattgaaatcttcctccgtataaacacccaaacgtctgtagccatagaaagaactcatgttctcacctacacgcaagatactttcagaaccacctacccagctgttcatctcgatatcctcattattgtcgcccaactgaaggatcttgttcttgttgaagtttaagttaatcgtagaactccaattgaagtcttgtgtctgaactgggcgtgcgctgatcattaagtccataccttggtttcttacagaaccgatattcttatacactgtcgtgaaacctgtagtgtgaggaatcgggcaatccaacaataagtcggttgtcttcttgttatagtaagctacatcgaaagacaagcggttctgccagaatccaatctcgaaaccaacatcaaactgaccagtcttctcccatttcaaatccgggttcgccatagagctgatgtaagaatacggagcgcgaatatcgttgatcaaaagcgtaccagaagaaacacgagccaatgaccgataagtgtcaatctcggagttaccagtcaaaccgtagctagtgtgcaacttcaaattgctgatcgtgctttgatcttgcatgaaatcctcttgagagatattccaagccaaacctgcagatgggaagaacgcatacttgttgttttcaccaaacttagaggaaccatcgacacgacctgttacggttgcggagtaacgatctttatatgtataagcgaaacgcaagaaataagagttcatcgcccaccgatcgtaagaagactcaggagatgccggagttgtacctgcggacatattattgtcctcaaagaaatcatccgagaaaccttctgttcgtgccttattccacttttgcacacgctcttgccaagacaaaccagccatagcgttgatacgatgatcaccgaataccttattgtaagtcaagtaagtctcctcctgccaataaagtgtattccaattttggtactcagcccaaccattcggcatggagatgttgttcaaatcgatagaagaataacctctatacgttttattatgatggtcaagacctagttgagtcttcaaatccaaaccttcagccaagtggaatgtcaaagcggcgttaccaaacacctgcgtgttgtagcgcatacgtttttgcatatccaagatcatgactgggttagacataccctcaaagcctaatacatcaccaatggaagaagaggtagaagtggtatatttaccattcttatcgcgaatcggcatccaaggaaccatctcgatcatggtacgacgagcctcttggccaccaccatcctcaggcgtataacgcccccatgtatggttaaccaatacattgactgccgtagacaaccacttcgtaggatttgcgtcgtatgccaacttcgcattaatacgcttattatacgtattgtttacaataccctgttgatccgtatagttcaagaaagcacccattgaagagctcttacccgcttgttggatattcaactgatggttgtgagaaaccgcggtacgagtagcctcatcttgccaattcgtatcatacagaggattaccgtttgcatcaaagaaatctgaatcattaaaccaatcagcacggttcaaagaccaatttttaccttgccacttattctcgttttccagaccaatcatgaatgcgtcacaccactcttgggcgttcatcgtatccatcttacgagcgatatggcttgcgctgacagatccttgatagctaacctgtacaccttcaccatctttcttaccacgcttcgtagttaccatgataacaccattggcaccacgagcaccgtagatagcggcagcggaagcatctttcaagacctccatagactcgatatcattcgggttcaccaagtcgaagttctccataacaacaccgtctaccacatatagagggtttgaagaagcgttgatagtagccataccacggataacgacacggttagaataagcacccggctggctggagtttgagaagatgtttacaccagataccttaccgcgcaagttgtctagcgcactaaagttttgattctttgtcaagtcgtctcctttagccacaccgatagaaccggtcacgtctgacttacgcatcgtaccataacctacaactacaacctcgtccaaagtttgagtgtcctcttttaaagttacttttattgaagattgatttcccaccgggatctcttgggacaaataaccgatataggataccaccaagatgtcatttgcggacacgccttccaacgagtaattaccgtcgaagtccgtgatcgtaccatttgtagtgcctttcaccaccacgttagcgccaataacaggctcacctgtaccgtgaaaaagcctcttagcttattaattatctgttgtttcatcttttagtgattacctcacgcaaatataacgaacattttctaaattccgttttatcgtgattcttttttggaaaatcatttacagaacaatatcctctaaaaacaaaagaagcgagagataccacctccccggaaatatcccccacctctctaaatttatttgacagatccccgacaagggtattatttcctacattttattaggaaaaaactaagcctaaatacgttgtaagcctcaaatatgggcaaaacaatgatatttaatcaaatctctttaacttcaaaaatgacctgaatttcacatcaaattcttctatctctgggccaacgtcttttccttgagaagagaaacaacacctcttgatcttctctataatagacttgtaggctctttgcgtcaattttccatcacgcacacgagccttcaatctagacctcaacggatcaaatccattacgattaacagactcacgtaaggtactatttagcaaacttcttactccatctatcttatcaagcggcaaagactctttactcaccttgactttggaataacaagacaagaaccgatccagcaaatcattccaaaagctaggatcatataacattgacgcagtaaccgatttcccaaagcacttcctaactttctttatccgaaactcgcatcgagctatattcttattattactcccctgttcctttcctttatcgtaaaacgaaagttctttctctgctgtttgaaacgtaattcctgtaggatatgaaagacgcctaaaataaggtaaatctaacatccgattgaaatattctattggagaccgctgtaactccaaatccattgctgaatccattctagtcacagtgaccttatccatagggatgtttaaatcctctcctatcccctcaatggctttccgtacgtcctctaaagggaaatcgtgcatgttggtaccgtagtaatatttacataagctacaagcattgatttttagaatatgagtatttacatacacattataccccttatatttcccacgtacataagggaggccatcattaccaatacaatcacttctatccatcaaatatggcgacacttccgctaacaaatctatttctggaacatctttctgattaagaacaaagtcaaccgtatcatataacatatgaccatgtaccatatcatgaaccatactactatattcagtacatgaatcatgtccttccttacagcttgatagatacacatagtatttagaagctatctcatccattcttacgtcctcccttctttccttctaaagtattctcgatatcggaaatagcataaaggacacgtcttcctattcgttgagcgggaatcattccttgtcttgtccaatcggccaaagttggcaaagaaatccgcaacatcttcgcagcctccgtacgagtaagaagccggatagaatcttcgctcttctgaagctttagatcatctaatatatcatctaatactttacgtactacagcttcaatatctgaaagtgaagcctgttggattaatatactttgtttcattaacaaataatttaaattaatggcacaaagtttatcaatcacacatttccactttttccattatttccaaatggaaataactatttagagaaatgagcacaaataagcttaaaattcgagatttcttctttcgaaagtccttcaatcccctttttctctatctcacgtaaatttctctcagtaacactattttctcctattgacgctttactaactacgacattaaaatagtcataaaagatgcgtgctacaattatcattttactatatctaagaatctcctggtctttcatgaatattattaatttggccaaatgattcttcgtcttatggacataccgctgttctcttacgatattaaactcctccagtttctctatcagtttatgtacaacatcctcgttatagccgttaaataggttgtagaacctatcttccttatatgatgatttatcgccacccttatcagaaacatttgacagttcactttgagagtaattcaacggttcttttaaacgactaattaaaacgaacgattaaactagtcgttttgttgccttcccctccacttcaatatcctgatatataagattataccatatgactataaaaaaatagagggtagattgatcactcagtccaccctcctgtctatcgtgtgcttaaactattaaaaatcaaccccttgattagtcttctagagccgcttgcgccgccgcgatacgagcgatgggcactctaaaaggtgaacatgatacgtaattcaagccaactttatggcagaacttaacggaagaaggctcaccaccatgctcgccgcaaataccacatttcaaatccggacggatggcacgacctttctcagttgccatacgaaccagctgtcctacaccattttggtctagtacttggaacggatcgaccttcaaaatcttcttctctaagtaaaccggtaagaaggaagcgatatcgtcacgagagtaaccaaatgtcatctgagtcaagtcattcgttccgaatgagaagaattcagcgctggaagcgatacgatccgctgtcaatgccgcacgaggaatctcgatcatcgtacctaccttgaattcgatacgatcgccaacttccttgaatagctcttcggccgcggtacggatcaccttctcttgttccttgaattcatataagatacctgttaatggtaccatgatttccggtttagcctcaataccttctttcttcaaatccaaagcggcacctaaaatggcccgagtctgcatttccgtaatttccggatatgtattacctagacggcaaccacggtgacccaacatcgggttatgctcgcaaagagattccacacgtttttggatctccttaacggacacgcccatagtctcagccatttcctcttgacctttcaaatcgtgaggaacgaactcatgcaaaggaggatcgagcaaacgaacggtaacaggacatccggccatagccttgaagatacccttaaagtcctctttctgataaggaaggatcttcgccaacgctttcttacgaccttcagcgtcctcggccaagatcatctcacgcatagctttgatcttctcaccctcgaagaacatatgctccgtacggcaaaggccaataccaacggcaccgaagctacgagcgatcgaagcgtcgtgaggcgtatcagcgtttgtacgaacttgcaattttgtatatttatcggctaaagccattaactcctcgaaatcacccgataactcagcggcttttgtctcaacctgcccgacatagacttctccggtcgtaccattgatagagatataatcaccttctttcaaagtcacgccatcaacgtctacagtcttattcttataatcgatgttcaaggcaccagcaccggatacgcagcacttccccataccacgagctacaacagcggcatgagatgtcatacctccacgagcggtaaggataccttcggcgacagccataccggccaagtcttccggagaagtctcaatacggaccatgacaacctttttgccatcggcatgccatttagcggcatcatcagcgaagaatacgatctgtccggtagcggcacccggtgaagccggcaaaccttttacccacactttcgccagtttctcggcttttttatcgaatacagggtgaagcaactcatctaatttattcggctcgatacggttcaacgctgttttctcatcaatcataccttgatgcaataagtcgatagcgattttcaccatagcggcaccggtacgtttaccgttacgggtttgcaagaaccaaagtttaccctcttgtacggtaaattccatatcttgcatatcccgataatgatcttccaatttctcttggatagcgtctaattgcttatagatttccggcatggcttcttccatggacggatatttagcgatacgttcttcttctgagattccggcacgttcagcccaacgttgtgaaccgatcttcgtgatctgttgcggggtacggatacctgctacaacatcctcaccttgagcgttaatcaagtactcgccattaaacaagtcctcaccattacccgcgtcacgagagaaacaaacgcctgtagcggaagtatcgcccatattaccgaataccatggcttgtacgctaaccgccgttccccactcgtctggaataccttccatcttacgatacaggatagcacgctcattcatccagctattgaacacggcacagatagcgccccacaattgctcataagcgcaagtcgggaaatcctgtccggtctgggccttaacggctgccttaaatttagagaccaatgttttcaagtcttcaacgtcaagctcgttatctaacttaacgcctttcgctttctttacttcctcgatgatcgcctcaaacggatcgatatcctctttgcttgtcggtttcatgcctaatacgacatctccgtacatttgaacgaaacgacgataggaatcccaagcgaaacgagcgttgcccgtcttacgagacaagccttccactacctcgtcgttcaagccaaggttcaatatcgtatccatcatacccggcatggacgcacgggcaccggagcgaactgaaactaacagaggattggcaacatcaccgaacttagagttcattaacgtttcgatattagcgatcgccttctcaacatccgctttcagcaactctacgactttatctttgcctaactcgtaatactctatacaaacttctgttgtaatcgtgaatcccggaggaaccggtacaccaatcagattcatctcggcaaggttagcgcctttaccacccagcagatttctcatatctgccttaccttcggcttttccatttccgaacgtgtaaactctttttctttccatattcgacagtattgaatttagattctagttttgttgatttcaactgttatattgctatctcaactttgcaatgctacaaatatatgctatttctactttgcaagcacgaatagcgttaaagatttttacatgttttacaactattctttaccatttatatccagcaaatgcttacatttgcgtgcggaagtttgttgacgcttccatttcccatcggatttcccgcctatctctttgccccttacatataattatatgatctttttcttttatttgtgtctatttatttccaataggaagactcaggagttttttgctgaagaaactttagtttctacagcatgaaactaaagtttctccctagtggaactaaagtttttctatagcaaaacaaaagttttccttataagaaattttaagaaactgcaatatattgatttataaacacatactatacatccctttctgtccataatcatatcttcatcaatcttgatagaataacgagaactgtttgccggactcatttaagtatatagaacgaagctctttgttcttagcggaattgtaagtattttcgcgaagcgaatttaaaacttaacgacattggcaagaaagaagaaacagttgcctatattagaaaaggtaaccattacggacgtagccgccgagggcaaggctatcgcgagagtgaacgatatggtggtatttgtacccttcgtcgctccgggagacgtggttgatattcaactgacccgtaagaagaatagttatgcggaggggaaacctgtatatttccatgagtactcggccaaacgtgcggagccgttttgtgagcacttcggtgtctgtggaggttgcaagtggcaacatcttccctatgaggaacaactttactataagcaaaaacaggtctacgataatcttacccgcatcgggaaagtcgaaatggaagagaaacttccgatcttaggttccgagcgcacgactttctaccggaacaagcttgagtttactttctcaaacaagaaatggcttacggaggaagagatccagtccggtgcttctttcgattgcatgaatggtgtcgggtttcatataccggggatgttcgataaggtattggacatccataaatgttggttgcaagatgatatatcgaacaagatccgtctttgcgtcaaggaatattgcctatctcatgagggatatcctttcttcgatttacggaaccaagagggattcgttcgtacgttgatgatccgtacggcatccactggggatttgatggtcgtattggttttcttccatgaggatgtagagcgcagggaagcgttattatctcatctggcggaacgattcccggaaatcacgtccttgatgtacgtcatcaacggcaaatgtaatgacacgatcaccgaccaagaagttctcgtattcaagggaaaagatcatatcatcgaggagatggaggggcttcaattcaaggtaggtcctaagtctttctatcagacaaacagtgaacaggcttataatctatataaagtggctagagaatttgcgggtcttaccggaaatgagatggtgtacgatttatataccgggacaggtacgatcgcaaatttcgtctctcgccaagcaaagaaggttatcggcatcgaatacgtaccggaggctatcgaggacgcaaaagtgaattccgccttgaaccatatagagaacacgcttttttatgccggtgatatgaaagatatccttacgcaggatttcataaaccaacacggacgtccggatgttattattaccgatccaccacgtgccggtatgcatgatgatgtgatcaacactattctcttcgccgagccggaacgtatcgtttacgttagctgcaatcctgctacgcaagcccgcgatttgagtttgttgagcgtgaaatactccgtcaagaaagtccgtccggtcgatatgtttcctcatacacatcatgtggagaacgtggttttgcttgagaaaaaataaacatataatataatgtataggaaatacgtcccctttctgctctttttgttcttcttgtatggttgcaacggtaacaaacaagaggagaaagaggacgtttccgttttcgtggatttaccgcaactgaaagcggaaggcgagatcacggcggtgactttatacagttctacctcctacttccaatataagatgcaacccatgggttacgaatacgatctgataaacgattttgccaagagccaaggtttgaaattaaacatcaaggtcgccgagaatcctgcccgcctgatcgagatgcttgaagccggtgaggccgatgttgtagcctaccctatcccaatcaataacaagctgaaacaagaggtcatttattgcggccgggaggatatctccagtcaagtattgatacaacgggccaataaaggcgataagcttcttaccgatgtcactcaattaatcgataagaatgtttacgtaaagcctaacaccaaatactccgaacgactgaagaacttggatgaggaactcggcggaggaatccatatccaaaaagtggaaaatgactccattgctaccgaagatcttatcgagatggtctccttgggcgaaattccctatacgatcagcgatgataacaccgcccgcctaaacaagacttattattggaatatcaatgtcgacctaaaggttagttttccccaacgctcttcatgggtggtaaggaaaagtagtccggacttggcgaaggccatcgatgaatgggcttctgataaaacgggtaaacattctttcaaggcagttactaagcggtactttgaattaagcaagcgaccttttaccgcagatattccggaggtaaagaatggacatatttccccgtatgaccctttattcaagaaacatgcgaaaaacatcggatgggattggcagctgctggcgtctatttcctatcaagagtctcatttcaatcctacggttgtatcgtgggccggtgccgaggggcttatgggaatcatgccaaatacggcgaaggcattaggtgtcaccccgcatgaattgaaagatccggatacgggaatccgtacgggagtagattgtttacggcgcttccgtcaaggtttttctgagattacggatcctgaagaaaaagtcaagtttaccctagcggcttacaacgctgggatcggacatatttacgatgcgcagcgattggcccgaaaatatggaaaagatcccaataaatgggataatagtgtagcggaatatattcgtttgaaaaatgatcccgagtattataacgatcctgtttgcaagcatggatacttgcgtggctcagaaacatataattacgtgcgggaagtgttggagcgttatcattactacaagaaaaagtcatagttataaaaaaattcatagctatgagtgaaagtagtcataactatgaattttctgcaagtaaatgccacttaaaaattataggcgacacctatgcctaatatttccttgaactggaccttcgccccccgtttctctccattatcctcaaaagttttcacgtcgttatcatatttaagcgtcgtattgagtgtagcggacaggaatttattaatcttcatgcttatcaatacatcccaattgacatcgatatttccgaattgatcgctataaggagtgaaaaagtcagctgtagtaatcaagttcacgttttccatcacgattaattccgcacgagctttcaagtaagctccccattccattctgaagcgatctcccggatcgaccccgaaagctcctaactcggaaaggtaatcatcctccacgaaagtcatcttcgtggaagccggagaaagataaaccgaataattgcttttgggacgatattccatacctacggagatattcgaatacgctggcgcaaagaagttcgatatataatgtgtcttatccggataattatatcctttggcaaactgggtgtttaaatctcccatcaacgtataataccatacattattggtggaatatcctaattgggtagacagggttatattatcggtacttttcctcattccctgcgatttagtctttgataatccgtaatcgagagcgagattggttacccataaccagtcaccgcttttatgtgttaatgccccattcagatacgcatttccggcaacagagttctcaccgccagccgaccaattcgacatcgccgtttgcgacaagttcaaacctgtcacacctttcagtacccatttgccttcctcatatcctttatcatccgtttgactatatgtgattgtcgttaatgcgacaaacaatgtcatgaagaatatacgtttcatattgtgatatattttagttattaaaaaataagacgtcctatcatttaaacaggtttgattaatttttgtttagaaaagcctgaagttgaaagggtgtcacatttgttacacctttatacggataaaccccttatttttgtatccgataattaagtaatttgatttatggaacagttacatgcacacgaagtccttcatatgatggagggtaatagttattcagaagcttctttaaaagaagcgatcgttaagacttttggtgaggatcagcgtttctatacttgttcggcggaaaatatggatgcggatgagttaatcgtatttctgaaacaaaaggggaaattcatgcctgtcgaaaatggtttcacggtagatattacaaaggtttgtaatcattaaagattctacgacactatcaatgactctaggctaaatcaaaagaatttagcctagagtcatttgcctaaagttaaaaaagactttcgattctactcaatggataatactattcctataaataatcgcaaatgatttttgcatcaattcataatctttatcagagacataacttggcctacggttacctgcgtgatttatcatccagacaaaagactctatatactttagtatcttatttgacttatcactttttatacgtgacaaataatccatttttcctaaaagataattactcacttcaagaacactcatcttattacactcattcaacaatgatattaattcaaggtcttccataatctttatttttattactacaaatataatatatttaatcaaataaacaaatcatatagacagattttcatctttaattcttttacataaaatagcaaaaatgggaaatgaacacatctctaaattatataccactaatctaaatgagatcattgaagttcattgccattagataggaagtagtttccttaaaaagaaatcagatgatcctgcaacaataaaaataggcttaaaagaaaaatatttaatagatttgttttgatattcaaataataaagattatgtttgatgcgcattttgttgcaagtgaaaatattggggattttttgacgttctggaataacacagacagcaacccggcaagttttgtactaccggattgttttttatccatgattgatcctatacgtgtaaaagtgtgagtccgaaaacctaccatacctgcgagccttccaacaaacattctataggccttttatgttatggttgtaaaatggtctatttatgcttactggttttttaaataccttagcgactataataagtgtgacaagccttctgattgtcacctatggtgcattaatcggagtcatctcatttttcagaaatgaacttaagcgacttactggtaattattccattactaacataagaaaactaagagctgcattcggtacatacttacttctcggactagaatttttgatagcgtcagatatcttaaaaacagtattggaaccaacacttaatgaattggccattttaggtggaatagtcgtgctgagaacagttctgtctgtctttctgaataaagagatcaaggaactagagactgaaaataaagataccgagtagatcccataaagttttcaagggaaagtacagaaaaatggcgcttaagtcttgcatgaacagaatttaaacgccatgaagtaaagttagaaaaccaaaccgctcggccttcacaggtgaagcggaagtggatatattgccttaaactaataccttatattattacaaccagattaaagatcataatgtttatgcttttgatgaatttcaatagccaaaataaaacagaaaataaaaatccgcatccagcgtcactgctacatgcggatcaaaaataacaaactcttacaagagttaggcactacataaagttgtattatactaataagcagactgaaccgcatcaaagtgttgattccttatgttgtttttttctcatcatttacatattccaaaatatcgcttggctgacagtctaatgctctacaaattgcctctagggtactaaaacgaattgctttcgcctttcccgtttttaagatagaaaggttagataatgtcaaaccaactctttcagaaagttcgttcaaagaaatcttccgctttgccatcattacatctaagtttacaataataggcataattaaactgttaagtcattctctgatttcatatctatcgcattttgcaataatttttcaaatacagccacggctgtcgcaactacgatagcgacaaaagtagttacgatacaaatggcaagaaaacctgcggggtcatcttctgtattatgggtcaaccttataaatagtcctgccaccacgattaaaatacttagtaagatcgcacaatgctttatgttcttcaaagtctttacagagtttgttgaaaacactttattttgcccaatataaccgagcaacctaaaagcattgtacaacgcaacaaaaaaagcgattgacgctccatatccatataagataaatggatcagcgtaagtactaaataaatctaggtgtgtggctcgtccctcagttaagggaaaccaaatcaaaataataagtgccacaataccgataagaacaataactgtttgaagaaatgctgttgaaattcttttcatgacgtatgatgttaattttaaacgacgttgcaaatgtaataaatatttattgataaacaataaatgaatagcgaaattcaaaaaacagtctctttctcaagctaattaaaaaatctggacttgaatcgccagtgtagtgtcgaagtacaatgatctcccatttggaagggagaatgggaatagaagaaaaaaagaacgcctacctgaaaagtggtagacgctcattgcatacggttattgggacaaatatagagtttatttctatcttggattatcctattcattaataactacttcatctcttctcccttttcattaaagatagcgatagcctccttgccttcgattaccaaaatcactttaaagagtttaccttcagtcttttccgcaacatatacctcttggatcgctgaatccggataagatttttaattaaacaatctattcatattaacgtaatcaatagatatagaacaacggatatgccgaatttcgcctatctacagataatcatgacacacaacatcttatattttagcattaacatatggattccatgcggaaacaaataaaaatccgcatccagcttcacagctacatgcggaccaaacaaataacaaactctacttatatgaaaaaacaaatactactaacaaattattatacgatgactactatcaagatgacttctgagtcattttatagtataacagaagattgtttgaaaaagttcaccagtaatttcttttaggctgagagcttttctttttatcgactgtttgaatataaaacatttcaagctgcaaattgttttacaaacaaagataaaaatgatgattgatcggtttgaggcatgattaagaagttactttctatattattgtttatgataatgctctttgccttccggatgaatgcggaagcggatgaggaacacttttctaacggttcctatcgttagcgcactaggattaacattaaatgaaagcgcttccgacgctatggttggtggagcggttacccaaaacgacaaatttcaagtaaaacacggcgattactcctaaatatttagggataatcgcttttttatgaatagatttcaagtaaaattaggacatttatccaattatatccgtaattttagcccaattaaatcaatagcaattatggaaagaatcgttaatcatcctattttaacaattccacaagagggagaacacacttttttattcaatggcaaacccgtaacgggaatgaagggttttaccatcgccgccgccttacatcaggccggctatccagtacacagtcatagcgtaaatggccgcaaccgttcgttgaattgcggtatcggtaaatgtggcgcctgcgaaatgctggtagacggagaagtaaagcgtatctgtattacgaaagtagacaatgtaaaggaagtatcggaaataacagtacagaattatacgacagattcccaaatagaacccagagaagaaccggtagagatctatcgaaccgatgtggccatcattggtgccggccccgctggattagcttgtagggaaaccttaaaagagctaggcttgaacagcatcgtaatcgatagcaatgataagattggcggtcaattcttgatgcaaacccatgcatttttctttttcgagaaagagcggcgctttggcggtatgcgtggtttcgatatagcgaaaactttagccggagacgaccactctggtattttcttacattctacggtctgggatatcctacaaaataagcgtattgccgtaaaagacatgcttaaccataaaaatttctatgtagaagctcaagccttgatagtcgctactggtgcggttccttttatgccgaccttcgagaatgatgatgtgcccggagtttatacagcggcagtcgtacagaaaatgatgaacgctgaattcacgttactcggcaaaaacatattgacagtaggcgccggtaatataggttacctaacgtcttaccaattgatgcaagccggagcgaaagtcaaggctattttagaggcgatgccccatgaaggtggatttccggtacaagcgaatcgaattcgccgccttggcatacctatttatacctctcatatgcttttgaaagccattccaaaccaggatcggacaggtatcaccggcgcggttgtctgcgaatgcgagaacttcaagccaatcccgggaacagagaaagtgattgatggtattgatgttattaatatatgtacaggattgattcccgacaaccaattgctaaccaaaggccaatatacatttggaaaacgttgtgccggcgtaggtgatgccgtacgaatcggagaaggtactaccgccgtactaagaggaaagcaagccgcttatgagatcgcccaagagctaggcgtacgtttcaactacaacgattacttacaaatatctaaggaatacatcgactcccagcaacatccgatccgcatcaaggaagagtccccaaggcccactcccgaacgtcaagcccaactccctttcgttcgtttggattgcctatacggtttcgcttgtaacccttgctctttcgcttgtcctcaaaaggcgatcaccaaaagctccaccagcgtaacgcccgagatcgattacgaaaaatgtaccggctgtatgcaatgcgtatcccattgtccggggctggctattttcggctacgatacccggaagcaaaacttattcttaccggtagaatacgaggtagaagaaggtgccgaggtgtggctcgtcgatgataacgggaagaaacaaggcgaaggtatcattgagaaagtattaaagaagccgacaaaaacaaacgtggcccgtgtgaaagcggcaggaatggaaaacgatgccttattgaatatcacaggattcatcgtaaaagaaaactatccggaggaaatcgacttcaagcaagagccggagtgtgagtcggagacctatgtttgccattgcgaggacgtatctttggacgagctactttccgccattggggatcgtaaatatatctccgtcgacgaggtaaaacatatcacccgcctaggaatggggccatgccggggaaaacgctgcataccccgcctacgcatgaaactaagggaaaaaggtatcgaactggtaggcgacgctaccccccgtgctcccctatctacccgcttcgtcctaggggaaatgtatccgcagcgtcagatagcggatacctataaagtagattccggaaagcaggttcgtaagacggaagtcttaatcgccggcggaggtataggtggtagcgcattgttccgttattttgcggaagccggtaaaaagaccgtgcttattaatgcggatcgaggatcatcatggcgtaatatcggtggtggtcgtccagcgttctcgatccccgaattagcggagatcgcccgtaataaccaaacgatattcgaggagacacaaaaagaatacgatatccattaccgtgagatacgctatatcacgttcgcccacgacgaggctacctacaatgatctggaacgttcctgcggttggtccaacgcttatttgatcgacaagaaagacttccagaaagaggtgtctccctacttcaacacgaaccaaaacacctatttcgccgcacaaatctcccagcattgttggcaagctaccccggggcgtgtgatagactttatacgaaacaaaggcaaagagcggcaaggtgaggttttggaagacacacacctagtggaagtacacaaaaacggtggaaaatatcacgtcttattatatacgcatgataagcgatacatcgaatacgaatgcgatcatttcgtgaacgccctcggttatagcgccgagcgtttcgcccgcatgctaggcctttacaccggcctctatccggtcaagcaccaagcgttgattacccatcgcctaccgaatctgggtaaagacggggatatcctcgatatgttgatagaccgccggaaacgtaacgacttctccgctgtctacggtcagcaattcgccgagaccggacagattatcgcttgcgcctcccccgctgtcgacgctaaagcggagatcagcaattttgatgagttgaagtttaatacccgtcgtttcatggagatcatctccgaggtgttctgcgattggattccatcgttagccacagtacccgtacaagccacatggtccggttattatgtagagcctcgctacattatcgatccggataacggactattcgtcggtttgcaaggtcacggcttcatgctcgctcaatacttggctaagctatacgtagataaagcgttaggccgtaccgttccggattatatggagcgattgaggctcgatggagacggaattagtgagaaagctttcaaataaactataaataaaacaaaacctcctctaccacaattggtaaggggaggttttgataaaaccaatcttttctatttttgttattctatatccataaatagtaatcatatgaatatagaaacaacagacaactcccctttgctacaggaatgtatagaagaattgatcagtagtaaaatcgatgaggggaaaggaagaaccgctgggaattatcgaagcgcatggaataaattatccacctttttaggtccgagagtaacggagtttacatttgccgacttaacgaccgattttcttcatcactatcttttatggttgatgcaaggggaagacgggaaacaggctcccttgaaaccgggtagtttggacttctacattcgtaatctaaagacaatgtacaacaagatcgctcaagataaacaaatggatgttccgagagaaagcccgttctccggcctgcagataaaggtcccacccacccggaaaagggctttgccaagcctcgacctacaaaatctggcgactcttgagcggcccaagaacccacacgcctgtacggcccttcacttggctcttttcttattttacgctagaggtatgtgcttcgtggatgtctttaatttgcgacacagcaatataaacgatgattatatccactacgtacgtagcaagactggcgtagcgatgcaagtaaagatcacccccgagatgaagaacatcatattctcttatcggcgtttcaataacccgtggatattccctttcttacacgagaaaatcagcggagagggagaagtcacggcccagtccgcgcttcggagagtgaaccgccacttaaagaaaatgggagagcaattacacttcgaacagccattcactacctatgtgatgcggcatagctgggcttccatgatgctggaggcgaattcggaaatcggcattatcagccaatccttaggacatatgtccctacggactaccgagatctatcttggccggatatcagtatctaaaatagacagggcctccgataatatgttgaataatttggttcgcggctcttcctcccggcaaagaagtaaaaataaggtgatggctttaagagacaatcctcctatacaaataaaagagacaatcggcaagaaatgcaagaagctcatttcctcgattgcctctaagttattctcatttatttaaaatagttcatgcaggaatgccaaagggtagattcgtcaaggcattcctgcacagcccttagaatggatactatttctcttcaccaaaattaacggtattctcgacattgtccacatcatcaaagacagccacgttgccgtttgtgatcgttacacggaggtcggcactattagggccggcgatattcaccgtcagcttataatgataatcccgatagatattgtaatcggtcaccaagtcacccccaagatagaatttatactctacatcgatcggcgaagagtatgctcctccacccaaaggatactgatattgccctcttaccaatagataagtgcatccttccaaagatccgccagcccccggtcccatatccttcttattcttctcttgcgccgtggtagctaaacctgtaccccggatattttccgccatatagaaaactccttctttatcaccaagtgatattccggatacaggtatctcctccgtatagaaattagtagataaaggacttgaaatcgttggatatgtcgagtcgtcatcatatagccgggttactttaggtacatttgacataataaccggtttcgtatcaattaacttaaaattgccagaggccactgaagagttcacggtcacggtcactttcgcgaacgccctgtacatacgggataatacgaccaacctcatgtcagcctctgagctagagggatccttcgtatagttagtcggtcccgaagatagtatattagtacctgttggagagccatctgatgaataaataatacttttcgttttagccatcaattctgttacagaaagggacgtagggataccaccttcttttacaaataacttggcggtaacctccgtcgcattcatatcctccgcatttacgatgatataaaactcactagtctcgttcttgaaacgcatatcatccttcattaattgaatcaataactggtcataggtagtgctactacttcccggcacagccgttatgctattcctatcggcaaagacagctttcaacaactcggttccatcctttttaaactgtaaaatccatacattatatatattagtatctcccaatttaagaattttcggttccgttcccgctttcgtctctacatcaatcgtacccggtacccttaacaggaactggaaagcacattcctcccctccttcggatgttgatggtatcatttcctcattactacatgcccctagcagcaagcatagtatacaaaataaacttattcttattctcattttcagttcctccttattctccaccaacgggatctgtcacattttttatttccgtgaattccaatatacccagagtcagttctgtctccttaaagtcaccaaagaacttcaaggtaaattcaaagctataggacataccgggcaagaaagtcttacgagcggtagcattgaatacaaaatgaccgggcacagatccaccatttccatttttatcataatctaccgttaaatcaattacaaactgtaattccgacccgcttaaaggcaatactattttacgtggatctgaggtatgaggcaggcctacagctacggaattattgaaagagctaaaatccactccgttgttttcattcgcaactccatccgaataccatgcattatcccctagcctataagttcttgaatcagataagtttttcatcgttataaagtttacacgcaagccttttacagtaacaggagatacactagccgcttttaccgacacctccacttgcgagcaaagccgcgtgaacggattcgtcaaggtaaccgacatcgtgttttgtcccgctttctggggctggacagttatatcgttcatgaacgtatacataaaatcttgcccattttgcacggtcaccagatttccatcacccaattccggcgcattctcttcattgtaggaagtgaaataaaggttatatacaccgcgatacaaaaatagggccttgcccgattgggcggtgacctttccatccgcacccaccacataagtaccttccgccgaaggagtaccagtttcaccagtcccagtcttagtaccggtctcagtcttagtctccaccttgaaagcatagactttaatcaacgctttatcattcaaggctgaaacggccgcagccttggttacgttcgcttgataaagatcgaactccaaggcaaccttatcaccttccccttcttccaaaaaagattccttttggcaacccaccaacgtgaccaaaagccatagacttacaaaacttaatacatatctcatatctcctcccttcttatttaaatacccacactcgtattctgatccgtactattttgccaatcgtatacggttacgccctcgaatgtaccttccatcttatcaatacgtatcttatagacataatgataacccgccaaccatttcaccccgctttcggaagaaatagaggcagtttcaaactcacgttccaccccatctacatccactgtcaaacggaacgacaatacttgctcggcagcgtccatcggggctacgagacaagatatgttcggttgcgtcaacgaggtttccaatattttcgaaccggtcaactctatcgaggatgtccccgctaggccattcagacgccctagttcctcccctgtcccgttcaatcgcatgtccgccttaccgatttgcagacgtccggtgttactacgtatatctatttttttcagcgttaagatctcatcgctggcattcgcagacttatagatatagaaactcacctttgtcaaggcatggaacaattgaaggctgattatttttgaggttttggaagcctgaaccggcgtagcataaaggtaatcgatctgtttaccatcgaatgtatccgcatcccggaccgtgacctcgacagagtacacgccggaggaggctgttacgttaatggccttaccttcttcttccgtaggataataagcatacacatccgtagcggtactacccagcagtggcgcggattcacatccccatgttactccggatttggaatacaccggattcacccatgtatcactggagttcttcaaatacaatttcacgttatccacagaggtagtcacagccttcgtaacagcgtcgtcagccaaagagaccgatcgcagctcaagggtggaacctgcctccacctccggtatcccgtctgactggcaagctcccaacagggaacagagggccaatccccaacctagattatataaatttctcatattcttcattctttatagattttaaatggatcaagtggcgctaataggattgtcgggaaccgttgtctccgtaaaccccattacttccacagaagtcaatatcaattcatcggatgacgtgaagttatatacatagttcttactagccccaaatgtgtatgccggctgagtaaatgtttgttgtgtagcctctggacttgaagcaccgtcaagcgtacgggaaacgcttagcttgaaactcatattcgctcccggtcttaagatacagacgaaagtatgcttatcgctagctgcggcattatcccctgtatgcaacatctcgatcgtttcagaagaagaggcaccagtccggatgccattgcctgccaaggtagccgtcacattcctatattttgtagtagcaccccctgatgaggcataattaattgagatcgtgatcttcgccgctactggcataaaggtaaagtttaccttgttgctactcaaggtaacgttagagccgcctttcgcttccagtttattgctttgccagaaattctcataggatttctggtcttgcagaataaaggtgaaagctgccggatatgaggccgagaatgaagaagccgtagatgatccggaaaccgtcaacgagcttcccgccgttttcggaatccacccgttcgtggcatcctttcggtaagtcacggtctggctcccaccattaatctgtatctcatcgtccgtactaaagctactcttatcatagttcgtagcgtcgaccgcacgggtagacagagaagaaacgatctccgccgtcacctccaagggctgtccaccttccagatccacctctgaggtacaggcgggggtgagcaatagcaataagcctccggacaggtggagcatggtttgtcgtatattcatagtataatgtatcataatgctatatagttgttaagttaaatttcctccagccatgatctcatccgtccatttgccgatggtacaactttccgggatcagcatgtcgttatgcaaggtcaaattatatgtatagtggtaaccggtccgcaaggcacaacccgttaaggtagccttgtaggtaacaccatcgcaagtgagagagaccgttagatccgtagcggaggttcctgcgctaccacctacagcccttaggataccacaccattcatatctccgggatgcatcgcccgggtaaggccgatatagcgtgatcgtctggttcgtagatacagccgtacgtatccccgtcgccgctaccgtaacggcatcattggcgatagaggtctcacgcttcacggtaaacttcaaggtcaacttcgaattgacgtgcgtaaatggcttgccggtcgacgtaaagtccagcgtaccgttgctggatgtggcatcacccgttttcagcaggttactggccagataagcagcgctcgtggtttgaaactggttgatggccgagtaatccgccggaaactgcgccgaatacgtaacggcaggctccaaggtcacaggcgaggttcccaccacggtccatgcggaagtcccgtcataccgatagctggccgattgggaagccgccgtcccacttgccttttttgtccttgtcacctttatctgatcgccggaaaggaaggatgtcctatcgaaaccattatccgagctaatcgcctcgccgcttttggtaacagggctgatctcggcaaataccgtcaccgggattccctccggagcggaaagccccgtctctatcccgttcgtgcaaccggagagagccagcgccatgtttaaggctcccatccatgctaaactgaggttcatgtaattcatattcatatttttctttttatgccgtaattaatagccgccgggcttaacgtctcccgttcccgctgaaccgctctctgtccaagggaggatatcggcgttcactgtaatcgcccggttagagcaaatgactcttaatcattgggtcgagggttcgagcccctcccaggtcacacgatttacttattggaaagatggcagagtggtcgattgcggcggtcttgaaaaccgttgaactgagaggttcccggggttcgaatccctgtctttccgcagagagtcctgtaaggcgaaagctttacgggattttttgtttttgaggcgtttgtccgggcacgaacggaaagaggtagtgggcatcgctagaatgagaaagtgtataataatatggaaacaggatcattgcggataagtgatatacggccggattttatctatatgatggaacaagccgtgaaagccccatcggggcataatacccaaccttggttgtttcgtgtgcaaaaggataggatacagattcttccggatatgagtaagtcccttccggtcgtagatccggataaccgtgagttatttattagcttaggatgtgccaccgagaatctttgcattgcggctgaggcaaaaggatatgctccgctaccggttttttcaggatcgggggagatcaccgtactcttgtcggaggcatcgatgattaaggagacgagtgggcttatcgaggaaatttcggtcagacagacgaatcgaggcatatattccggggaaatgattccatcggatcaattgagctatttgaggaatacgcctttggaggaaaatatcagtctgcatttgtggtcgaaaggagagtgggagttcgatacgctttcttcttatatatttgcggggaataaccggcaaatgaacgatcatctgtttaaacgagagctgaaatcatggatgcgttttaataagaatcatgtacgagctacatcggacggcctgagttatgcggtgttcggggcgccgaatcttccccgtcttatctcagagacaatcatgggaagtgtcttgaaagccggcatacaaaataggggagacaagaagaagctggactcttcttctcatttagccttgtttgccttacggacaaatacgctaccggaatggtttgcgctaggccggagtttgcaacgttttcttttgagagctacggaaaagaatatcgctttcgcctttttgaaccagccttgtgaggtgcgtgatctttccggtttgctggcgaaagacttgtctttcaccaacgagattcctgccttgatcctccgtctgggatacgctaagcggaaaatgccgtactcacctcgaaagtcttggcgtgagaggctggttccgtaatggttaagtcagatagcgagtgccctcgttcatgccagcttgcacgggatatgccaagacgaaactgtttgcctgaaagtatttgttgaggtacttggggatacgggccatggcgggagcgtaggaaagtccttccttgcggctaaggataatccacatcgtgtcgtccggttttatatcccggaaaacgatcaggaagtcatcccagtcgttgaattcgatataactggcttctccgcttttcttggctaataatttctttaaggcattcaaggtcgcttccgaaccgtaaaagactgtcgctgcacctgtgttctgggtcacgtttcgtagccggaagatgatttggttgaaaccgatttctttttcggccaattccgggatgatgatcagatgccgtctaacagtagagatgggttgtgcgggcttgtatatgaatgtgcttacactactttccgccaatacgctttccacgatatggccaaggaaggccgccggtatatctttttccttgtgcaatcccactaccagatctgtgatctcccgctcttttaccacgctggcgatagcattcgatatgcttaagtcatatcttaataaatccttcatccgggtatccgtggcggcagccgtattgactgcggtctgtagaaccctgcgggattgttttaacgctttctcgtctgaatgatggttatctatcacttttagggcaaacaagccgttcttgttttggggagatttgatcgccaagctgaggttgaccagctcttccacggtcttttcattgctgaccggtatcaagatatgctctgattcttttttgttttcctccttatcggatatatcttgggccgctatgttatgagcgcctttttgggcggcgaaagaggcgatggtgcaagtgacaagtatcatcaggatcgtaccgttcaacacgctctcatttaataaccggattggttccccattagcgtctgttccggtgattacgttatatccgaccatcacggcggccaatgtagcggcggcttgtgcgttacttaggccgaaaataacgcttcgctgatccgtggacagatggaaagtcttttgggtcatccaagcggctatgtatttggcggccgtagctacgataatcatgataagtcctactttaatggtctcgaaactggtaaagaacgtacgataatctattaacatacctacgcccaacaagaagaatgggatgaatatggcatttcctacgaactcgacacgattcatcaaaggtgagctttgcgggataaggcgatttagggctagtccggataagaacgccccgatgatcgcctccatgcccgctacctgagctaggaaagatcccagaaataccatcaccagcacgaatatatactgtgatatattatcgtgtacatgcttaaagaaccaacgcccaatgaaagggaaaccgaataatacgattaacgcgaatatcaagatggaaacccccagacgaatccaaaacatatcgttgacctgtccggtggccatgccgacaatgatcgttaggacgagcaatgccaaggtatcagtgatcatcgttcctcctacggtgatactgacagctttgtttttgctgatacccagtttactgataatcggataggcgatcaatgtatgggaggcgaacatactggcgagtaaaacggaggtcaatacgttgaattgcaggacccatatcccgacaaccgttcctaggatcatcggaatgaggaatgtgtacatgccgaaagctaggcttttcgtactatttctcttaaaatccgccatatcgatttccaatccggcgagaaacatgatataaagcaatcccgccgtcccggacaagataatgctgctatcccgtaatacgagattaaagccatgcggtccgataattgcgccggcaatgatcagtccaagcaggtgagggattctcagcttgtttaataaaaggggagcggccaggataattaaaagaatcaagagaaattttaataccgggtccgctaagggcaatgtgaaatctattgtcgaggctaataccatatgcgtaattttttcgttataatttgaaacaaaaataataagaatttgcggagattgcagcgtttacgccaactttgcatcttcttttatagataacaataaatgtgtgagttttataagttaaagtatatgtaaatcttgggacattagcgtgaaccgattatatttgtacatacattgcattgagtttattgttataaaactaaaaagcgtttaaaccctttgcataaaagggtgtcaaacatgaaaagagaaaaatatttatttaatgtagaggagaaacaaatatgaaacccatgaaattaacatctttagtgatgatgcttctgatcgcgtttagtgccgcggctcaggaggagttctttgatgatgtgtatttctcttccaaaaacaagaaaaagaaagaacaggttgaagagaaaaaggttgttcagccgaaacaggagtctaggaccctggtcgctacagccaagagccaagcttcttcagacagccgggatgtggatgaatataaccgtcgttatacatcagtcgaggtggaggagccttatcgtgaggatgattccgttatctatgaggatagcgatgagaatgagtcttcttccgagcgtcgttcggatactgaatatacggaacgtatcattcgttatcattcgccgagtaagattacgatcgccggagcggatcaagtcgatttgtatctgagtgacggatattatggttacggctatgatacggattattcgaacggtagcgcgaacgtgaattttaatatcaatgtcggcaacggttggggctcgccttggtatacaggttggtacgatccttggttctatagttatagcccttggtggacttattcatctcgcttctacggcccgtcttggggattcggctggggctggggaggcttttatgccggctattatagtccgtggtacgatccatggtatggcccgtcttggggctggggtggaggctattggggtggccattggggacatcaccatcattactatcccggttactactcgactccaagtagacattattcaaacggacgttcctcttatcgagataatcgctcttatgcgagtggcagaggttccggttatacaggtgggcggagcagtggctcttcttccttgagaaattccggatcgactacaagaccttcgtcttcaagttccttgagcaatggacgtgcgggatctacccgtagggaatctgctatttcctctggtgcgggacgtcgttcctcttcttctgttagaaattcggcaacgacaagaagtagctcgggcataagtaatagctcggcgagaacaaggatttccagaagtagttctggagccgcatcttcttccggacgtcaatattcagctccggtaacacgttcttcttccagaagcagtagcgatttctcaaatagtcgctcttcttccagtcaatttagaagttcctctccttctcgtagtagttcggtaggttcttcttccggtagcttcggtggaggtcgttctagtggaggctctgttggtggcggaggtggccgtgccggtggtggtcgcaggtaaaagtgttaggttgataaaattagagatacgatgaaaaggataggaattataatgtcggtgcttgccctgtgtggcggcaccgctttttcgcagtcacagttggatgcctttaagtattcccagacggagttgaatggtacggctcgttatttaggaatgggtggtgcttttggtgcgttaggtggtgatatttccgctatgaatacgaacccggcaggcttggcgatttataaaagctcggaggtggttacgacattgagtttgtcttcggcctccgcgaagaccgattggcttggttcgaaggtggacaacagccgtacgaaggtgagtttcgataatatcgcttacgtaggatatttcccgacagcgaatgatgagggtatcgtgagctggaacgttggtttctcttataatcgcttgaagaattataaccggaactatacgatggctacaggaggtgatttgaatacttctctttctgattatgtggccatgcgtgcggcaggaatgcctagcggactgttgggggagggtaaagactataacccttataataaccaagacttaggtgattggctatctattctaggatacaatgccggttatatggattcatataacgataatgataaagagtattatagtgcgttcggggataaagatgcggatgggcaatggagtccgtatttattgcaaggaggtcaattaaaagtttcagagcgaggttccgtggatcaatatgacttggctttcggtataaatatatcggaacttgtgatgcttggcgctacggttgcgattacggatctgaactatagatatcagtcatcgtatgatgaggaatttacgaacggcaataatttatacttagataattacttggatacggatggtaccgggtattcatttaatgtgggtgccattgttcgtcctactgattttcttcgtttaggtgtagcttataattcacctacgtggtataagatgacagatcgttattatggtgaggccggttcttatctgacctttatggataaaggggagatgaaggagcgtaaactggatgcggctactcctaataatgcttattatgactatgaattccgttctccggataaatggatctttagtgccgccgcaatcttgggtacgaccgctttgataagcgttgattacgagttgatgaattataagaatatgcgtatgtatcaaacggatggtagcagtaacgtgtatactaaccaagatataacggataatttcaagtcaatgaatacgatccgtgtaggtgcggaggtaaaggttactcctcaatttgccgtaagagcaggtgtcgcctacagcgatagtccgatcaaggataaactgaagaatggagagaaagaggtctttacggttggtacgattcctaattatacgatcgataaaggggtcatgaattatacggtaggtatcggttatcgcttcaccccgaacttctatacggacttggcttgtgtattccgtacgcataaggaagatgtttatgcgttctctaatatgtttgcgggagatgatccgaagccattcctcgaagcccaacccgccacgatgaaaacaaacacgactcgtgtagctttgacattgggatacaagttctaatatacatatattttagatcagtaaagtcccctgttcgtacgttaaaggtgcgggcaggggacattctttttataatttgaaataaaatgtttgttggtttaaaatatttttcgttcttttgctttcataaataacattgtataacagttaaaccccatcgcctatagcataaacattactcgaataaactaaaaatgtgaaagtaatgaagactttaaaaatgatgaccgacgaggaattggttgtcctttatgcagaaggtaataatgccgctttcgatattttattaaatcgatacaaaagtagcattcattcttacatttatttcatagtacgtaacaaagagcttacggaggatatctttcaagagaccttcgtgaaggttatcatgactataaaacaaggtcgctataccgagaacggcaagtttaaggcatggattactcgtattgcccataacttgattatagataatttccgtcaggaacgtagcgagaacacgatctcgaatgatgaggtagaaatcgacttatttaataacatcaagctttgcgatggtacgatagaggataatatcgtgcgccatcaagtattgtctgacgtgaagaaattggtaaagcatttgccggataaccagcgtgaggtgttggagatgcgttactatcaagatcttagttttaaggaaatcgccgatatcacgggggttagcatcaatacggccttagggcgtatacgttacgctatattgaatatgcgccgtatggccgatgagaaccgtatcgagctatctatggtgtaaaataattttctttccatgcaataagtcttaggtccctacgttttattagcaaacaagataaaaataaaggtgcctatgaggaagctttctacgcaatgcatggatgatttggagaaaaaagtgaaaagtgccccggaggcgaaaagttcgcctcggaagcaaacgatggatttcttgaaacagtttgcgagggcttatcaagcggaaccggctgtacgtccggagctctgcgggtatgtgttgaactaagaattacggaaagagaatctatattattaggttctctttctttttttgtgtacttttgtaaaaacaaaagacaagattatgaagcatttgatagcgccttccctgctttccgctaattttctggatttgcggaaggaggtggagatgataaataaaagtgacgccgattggttgcatctggatattatggatggggtattcgtgccgaatatctcgtttggtttcccggtacttaacgcattaaagcctatatgccagaagccgatggatgtgcacttgatgatcgtggagccccagaagtttatccctgaggtcgcggctacgggagcctatatgatgaacgtgcattatgaggcatgtacccatttgcatcggacggtagcggctattaaggaaacgggcatgaaagcgggtgttaccttgaatccgcatacgcccatctgcttattggaagatataatccaagatgtggacatggttttattgatgtccgtgaatccgggatttggtggtcaacgcttcattgagcattccgtagataaggtggcccgtctacgggaaatgatagaccggaagggattgagtactatgatcgaggtagatggcggggtgaatttagagacgggaaagcgtttggttgacgcaggtgccgatgtattagtcgccggtaacttcgtattcaaatctccagatccgatacaaacaattaaagacttgaaagctttgtagaacacattaatatatcacaaaacctaactatcatgattgaggaaatacaaaagcggccttttgtacggccgctttttttatggataaccggaattttatgctatgcgtttttacctacctctttgcttttatatgttttaggggttttatctgctctggtttttctttttctggggttctcgtgggggcgagggcatgcggagttgcgatacgattcccgttggatatggggagctatagtctctgttttgattgtatgtttggcggttgaggtctgttggtatagtgaccggcgtatagcgcttgtaaatgagcctgcttcttctttagatttattggctaccaaggctcaatattctttggtaaatacatttgatcgtttgcgtttgtctgatgaggagaaatctattttggctacattgacattgggatataagaaagcgatgagtcgggaaacgaaaaggcgcttctctttggcgggcgtgtctcatatattagcggtgagcggttttcatgttgccgtgatttgtggattcttatctttcttttgctcgtttatgccaaaatgggggataggacgttgggttcgttatatcattctggtgggaagtctttgggggtttgtctttatcacaggattagcgccctcggcggtacgggccgccttgatgctgtctttatatttaacaggaagggcgcttaggcgtgttacggatggatataatacattggtcgccgccgctttctgtatgctggcctataatccgtattatctgtttgatgtcggttttcagttaagctatttggccgtgttttttattttattcctagtgcctcgtttcaaggaatggatagtggtgagaaatcctttgttggccatgccttgggaatggattacggtgtctatagctgcgcagatagggactgctttgctctgtttttattattttggacaattttcgacagttttcttgtttacgaatctaccggtcactctcttggctatgtttttgattccttttgcctttttgtggttaggctatccggtagatttctgtggatatgactggatacagaagatcgtagaagggctggttcatggcatggtaagggtggtggacgtgtttagcgttatgccttatgcgacgattacgggtcgttttagcttctttgagatgctaggaggttatggttttcttgttttatgcttgatatatatgaagatacgggaaccaaaagttttgttggccgccttaacccttttgttaataatatcagtaaagatccttattgaactttttttgatagccggaaactaaaaaagtcgtacctttggggtgaaaacaaaaagattatatgatcactaaaatcattcaagaagagaagattcagaaagccaaaaaatacgtagagaaaggcgagagttttgttatcgtgacgcatgtctcaccagacggcgacgcattaggttcatcccttggtttatatcatttcctatccgcttacggtaaggataatgtagcggtagtggtaccgaacgcatttccctctttttatagatggatgccgggcgctaaggatgtcgtgatacatgagaaatatccggatttcgccgagaaattgatcaaggaagcggatgttattttctgcctcgatttcaatgaacccaaacgtatcgagaaactggctccggcggtgatcgcctcagaaggccgcaaggtgatgattgatcatcatttgaaccccgcggatttttgtcgtgtgacgatgtcgtatccggagatgtcttctaccagtgagatgatcttccgttttatttgtcgtatggggatgttcgacttattgaatcgggatgccgccgcttgtatctatacgggtatgatgacggatacgggatcgttcacctataattcgaataaaccggagatttatacgattgtcagcgaattgatcaagaaggggattgataaggatttgatctatcgtaaggtgaatcaggtctattccgagtgccgtttacgtatgatgggatatgtgttgtatgagaagatgagggtctatccggaacaacaggcggctcttatcacattatcgaaagaggaactggatcgttttcagtaccagactggagatacggaaggtttcgtgaacttaccgttaagcatagagaacgtaagctttagtgtctttattcgtgaggacagcgattacataaaggtatcgcttcgctccgtgggcgatttcccttgcaaccagtttgcctctacttatttcaacgggggtggacataaaaatgcgtccggaggtgagttctatggctctttatctgaggccgtagccgtgtttgagaaaggtttacaggaatttaatcctaataaatcagaagatttaggcaaacatgcgtaaggtttgacgaagattatttacatttgcgattcattcaattaaagactaacaaatgaagaaaggttttaatatcctgttgattctgtgtgccgcattagttgctatctcttgtagcaagacaaagtcgtacacggatatgttgaaagatgagaaaaaggcaatcgagcgtttgatcgatgctaatgattttgagattttagacgattttcctaaagatagcatcttcaaggagaatcaattcgttaaattagaaaatggtgtttatttgaatatcatagataagggttctagtgagcgtgcggtgcagtataaaacgaaaatgttgtaccgttgtaaattgcactacatactggaggtggataccttggtgtacgagaattatggcccacatagcaatgggacttatcccattccgttcacatacggcgattattcgaacagtaatccatacgatccttcctatcaatgggtaagcgaaggtttgcagactcctttgcaatatgtgggagaccgggctagagtaaaacttatcgttccttttaagcggggcacctattatgaccagtcgaaaggcttgcctgtatattatgaaattctagaatatatatttgaagaaaacttatgacactaattaaatctatttccggtattcgcggtacaataggcggtagcccggaagacggattgaatccgttagctattgttaagtttgtagccgcttatgctacattcatccgaaaaaacacaaaagtggagaccaataagatcgttgtagggcgtgacgcacgtatctccggtccgatggttaaacaagtcgtcctaggaacgcttaccggcatgggatttgatgtggtggatatcgatctggccacgactcctactaccgaattggccgtagctatggaaggggcttgcggaggtattatccttaccgccagtcataatccgaagcaatggaatgccttgaagcttttgaatgagaaaggtgagttcttgaatgccgctgagggggctgaggtattacgcatagctgccgccgaggacttcgagttcgccgacgtggatcatttgggcaaggtaatcccgaatgcgacttataagcaaaaacatattgagagcgtcttgaatctggatctcgtggacgtggaggctattaaggccgctaatttccgtgtagctatcgattgcgtgaactccgtaggcggtatcgtgatccctgatttattatatgcgttgggcgtgaaggaaatcttcaagctgcattgcgctcctcatggaaacttctctcataatccggaacccattccggaaaacttgacagagatctccgatttgatgggacatgcgaaagcggatgtcggtttcgtagtagatccggacgtagaccgtttggcgattatctgcgagaatggcgagatgttcaacgaggaatacactttggtcgctgtcagtgattacgtattaagccatactccgggtaatacggtaagtaacctgagctccagccgtgcgcttcgtgacgttacccgtgctcatggctgcgaatataatgccgccgctgtaggtgaggtaaatgtggttaccaagatgaaggctacgaatgcagtgatcggtggtgagggcaacggtggagtgatctatccggccagccattacggacgcgacgctttggtaggtatcgccttgttcctgactcatctggcaaagaagaagatgaagacaagcgagttgaaggcttcttatcctccgtattttatctccaagcaaaaagtccagttaacgccggagatcgacgtggacgctatcttagcgaaagtaaaagagaagttctctcaatatgatattacggatatcgacggcgtaaagatcgatttcccggataaatgggttcatttgcgtaaaagcaatacggaaccgatcatccgtatctactctgaggcccatacgatggaggaagccgaggaattaggcggtcaattaatacagatcatcaacgagatgtgtaaataacaccctttcggggcgttttaaaatattgggttcagtcttcagccgaggtaagctatttatactctgttgatttgactgaacccttttcttttggataattctcggttcgtgtaatgaataaactaataaaggtaatcttatttctaattgtcgggatggttcaagccttcgcatggggagggctgagaggggacacgttggccaaggagctggatgaagctgtcttgaatagatctttttatcttcagcaacgggagcaacggatcacgcagctaaaggacatgtttctcttgagcaagatatcgttgtggcaggaatatgagatcaaccaccaattatacgaggaattcaagaaaatacaacaagactcggccatctattacataaagcggaatatggagatagcgtcatttatgaaggatacggcacgcatctatacttcccgcttacggctggctacgctttatgctttctccgggatgtaccgtgagtcggaaagtctgttgcgaagcatagaccgtgagttgctgtctaaagagcagaaacaggatttctatgaggcttattattcgtttttctcttattacagtacgaatctggattcttttgaatataggaaacaacttgatttatacaaggattcgttattgtctgtcttagatacggtctcttatcggtataagataaatctggcgcagaaatatctggctcacggacaggcgaggtctgcggagaaggtgctcatccctttattggagaaagaggagcggtataacccgaatttcgcgatgatcacttatctgctgggagatgtctatgagatggatgggcgtaccgatctcgcccgagactattataccttgtcggttatcgccgatatcaagagggccttcttggatagtggttctatccaaaagctggcgttgaattattatgaaagtggtgatctatccaatgcccttaaatatgcgcagctagctatagaaggtgccgttacttgtaatatacagttccgcatgaatgagatctctaaattctatcctatcattaatgcttcctatcagacacgggaagctcagggcaaaaggcaattgatgacttatttcttgttgatcagcctattgacgctctttctgatcctttctcttgcctatgtgtataagcagatgcggaagatctcagcgatacgagaagagttggttaataccaatgcctgtttggtaaagttgaatggagagataagcgagacgaataatttattgcaagagcgaaatatacagctatcggagtcaaaccatatcaaagaggaatacatcgctcatttcctcgatctctgctccacctatattaataaactggaggattaccagaaatcgctacagaaaaaggcgatgaataaacagttggacgagttattcaagatgctccgttcgacccgtatggtggagaatgaggtggaagcgctttatgttaacttcgatcgaatctttcttggattatatcctacgtttgtcagggacttcaacgctttgttgcagcccgaggaacgtatcgtcttgaaatcggaggatctgttgaataaggaacttcgtatattcgccttgatgcggttgggagttacggacagcgtaaggatagccgcttttcttcgttgttcgttgagtacgatctataactaccggaccaaggtacgtaataaggcgttagtgcctcgtgatgagtttgaaggttgggtgatgaggatcggggttaaccggaatccgttataatcaatctacattttttaggatagtgatctttattaactgatttgtatttaatgggatagaggatcgtactgtctacatttttatatcaatcttctttttgcttcttattcccggatacatttgcggcataacttttaaaaagagatgccatgaagattaaattaatgattgccgccgtgatcgcctgtttggtgttcacgggatttacgaaagagaacgtatccgatacggtcgatcacaacgcatggaagacatccggcgtcgtggtcatacaaaatgatgtccttacgttggccggttccaacgcccgtgctttgttgaacgatggcaaaggctatacgaacttcgagttagatatggatgtacgtaccacgaccggtggcaaaggttatattggtatccatacggacgctacggatcgtaaaggataccgtatcgccttgaacaacgatcgggaagatccggtttggtggcggatgacgggtagcttggtgtcagtccggaacctgacgaagagtttcgtgaaagagaacgaatggttcaagatgaatatccgggtagaaggacggcttatccgggtgcggattaatggtgagactgtcgtagaatatatagagccttccaaacctttccgtttgaaggagaacgctaaagcattgttatcccaaggtactatctcgctggtaggtacgggacgtggaaatcttcagtttaagaatatctctttagaggtgttcagcgcgaaaggaatagacattcccgctcaatgggcgaatgccgtggatgagcagacggacgagattattcgtttgcatcaagaggacttccccgtgcttgattatcatgttcatttaaaaggtggattgacgaaggaagtagccgcacggcagtcacgccagacgggtgttaattatggcttggctatcaattgtggcatcggcttctcgatcacgaacgatacggagttgtataattatctggataccatgcgtacccaaccctttatcttggctatgcaagcggaaggacgtgagtgggtaaccaccttttcggaggcggcccgcaacagcttcgactatgtgtttaccgatgccatgacgtttctggatcataaggggcggcgtacgcacctatgggtaaacaaggaagtgattatcgatgatgagcaagcatatatggatatgatgttggaccgtatctgttctgtcttggaagagccggtcgatatgtacgtgaattcccgtttccttccctacgcgatgagtgaccgatatgatatgttttggacagaggagcgtatcgaccgtttcgtgaatgccttggcaaaaagtggaaaggctttggagataaacgagctttatcatattccgaataaagcgatcattcagaaagcgaaagccgcgggtgtaaagttcacgttcggttccaacaatatcacgccggaggtaggaacgctcgattattgcatccgtatgaaaaaggaatgcggtttgacggcgcaagatatgtataaaccacacattaatatataagattagttttaaggtctgaacaaacattagatttaaggtagaggtattagtgctttaggcaaagattgttaggtttcgaggtaagatacatatggagttacagttataatataataggtcgattactataggacaaaacatttatttactatatataaagataatcatatatagttacattccacaaaccacggcgtgaatcgtacagaccacagcatggtttgtataattcacgtcgtggtctgtacagttcacgccgtggtttgtggaatgtaacagtatcttacgaagaatgaacaggctcttgaataactattctagctgaagtgtagcgtttttatcctataggaaaatagcggtgaattccttttcgaaattcggggtgaatgtgcctttccccagattctccttgatctcctcgatcggccagaaacgtcctccgtccagttcctcgggatcgggggtgatggggccatcgtaagtggtccggaagctgtttaccaattccttctctatggaagactcgaatatataacgtttgatgaagacaggcgtgaaatcggtaatgcccaattcctcacgaacctcacggcgcagggcctcttccacgctttctccataatcaatatgcccacctacggccgtgtcccattttcccggttgtatatccttgttcatggaacgtttttgtagatatagatctccatccttattaaagatatgtaaatggattacgggatgtagcaacttacttccgctatgacattccttgcgagtagcctttccgatcgtctcaccttcctcgtttaccagaggaaaccattctgttctcatattttaaatagactttaatttactgataaccgtacctaactcctcatccgttaaattatttccatacgtagcgtaatccaagcggaatgtacatccattcttgtattcagagcaaccataagcggttttgccccggaggatagagcctttgtgacagatggggcaaacgggcttttccgttgatggaagctccaattcaggagtagcctctgctttctctttctctttcttggcacgaggcttacgaggtttcttttcctttttctccttgggttcgtctttgggagtttctttagctgctttagacgtatcctcaatcgtaatcgttcgccgggtttggtcggaaaggacgtttatgacgacctcgtttaccatctgcttcaactcatcaaggaaagttcgggcctcataagttccccgctcgatctggcgaagcttcttctcccaaagccccgtcaactccgcgcttttcagcagttcctcatggatcgtgccgatcaattctgcgccggtagcggtgggataaagattcttacgttcctttcgtatataattacgcttaaataaagtctcgatgatcgccgcacgggtagaaggacggccgatgccgttttcctttaaggcatcccgcagctcgtcattatccactaatttaccggcggtttccatcgcccgcaataaagtagcttccgtataaggtttcggaggctgggtccaagtctctttcaagatcggtttatgcgggccactttctcctttcacgaaatcgggcaatacgccttcttcctcggtaggttcagcctccggatctttctgctcggctccgaatacgacacgccaacccggtttgaggatttgctttccagtcaccttgaattctaccttatccacttgacccaagaccgtagtggtcgatatctcgcaatccggataaaaggcggcgataaaacgacgggctaccaaatcgtacaccttccgttccgtatccgtaagattgcgggcggggactccggtagggatgatcgcatggtgatcggtaaccttcgagttatcaaacactttcttgctcttcggcaatttctgattcatcaaaggagcggtaagctccgtataatccaccaaccctttcaaggtattgggaactttcggatagatatcatcactaaggaaagtcgtgtctacacgtgggtaggttgtcaccttcttctcgtagagcgattggatcaactttagcgtatcgtccgccgtaaacgcgaatttcttattacattccacctgcaacgaggtcaagtcgaataggcggggggcgaattccttccctttcttctcggtgatactggtaacagtaaaatcctgttcctttaccttctccagaaaagcctcgccttcctctttcttcgtgaacttacctttcgtggcggagaaagtcgtattcctgtaaatggtctttaattcccaatagggttccggcttgaaattgtcgatctcggcttgccggtttacgatcaaggcgagcgttggggtttgcacacggccgatcgataatacctgccggttctgcccgtagcgcaaggtataaaggcgggtggcgttcatccccagcaaccagtcgccgatggcacgggatagcccggcctcatataacttattgaattccgtctgttctttgagtttttggaaaccttcccggatcgcctcctccgtaagcgaggagatccaaaggcggtagaccgggcatttacaacctgccttttgcatgacccagcgttggatcagctctccctcttggccggcatcaccgcagttaatgaccatctcggcattttgcatcaggctctcgattaccttgaattgttgctcatacgtaggattctcgattagtttgataccgaaccggggagggatcataggtagcgaccccagactccagcgtttccagttctccgcgtattcatgcggttctttcagggtacacaaatgcccgaatgtccaagttacctgatatccgtttccttcgatatacccattcattcgttgggttgcccctaatacttccgcgatttcccgggccacactcggcttttcggcgatacaaactttcatcaatacattatcctttcttaaatgaacagacaaaaatacatgattatttccgaatgagcaaagatgtttgttatcgcgagtttataaagctgtatgatggagttgctgattttggttcaatttgtttttacctttgggaattttgcatacatttgaacctatgtaatcgaagtgggagaataagtcgaatggcagacattgattcagagaaagaaagaaggcttgtggcggacttgctagaaggggacgagtcggccttttgtgaattatatgccctgtataaggaccgcttgatgtggttttccttgaaattccttaaatcccgggatatggcggaagatgtttttcaggatgctttcgcctctatttggcagaatcgccgtttcttgaacccgaatgtaccttttggcccgtatgtgtatacgatcgtgaaaaatcggatcttaaacctgttggcgggactggatcgtgagttggagctgagggataagatacggtccgcctcattggatagcacgaacgagacggaggactcggtattggatacggatttaaacgcattgttggataaggcgcttgaaacgttgaccccacaacaaaaaagggtttttgatatgagccgtaaagatatgaaatcccataaggagatagccgacagtttgggtatctcggtatatacggtacaacaacatatctctacggccttgaaagtgatccgggcgtttctggctaaatatgcggagacttatatgaagctactgctctaaaaacacacctccctttattcatattcccgataggcaccgaaccgggctaagcgatcctcgccgagttgttccggtacaggttgcggggagaggcccaagccttcgttgatctgttcccaaagtcccgtacgggtgtaagtttgatgcactttctggaaatgggtggaaagtaataaatccttggcttcttgatattgcttcttatcaatcagtagctgtacctttcgctcgaccacccattcatcagaggacgcgtttatcttatccagccatttttcccgttccggtaaagcctcggttccaaacttctttaatactttatcccgctcgataaccaactggggatgtaggttcaaccacgaggtctcggggatagcggcgtaagtatctctcgccttttcccacgcctgccgacgaacatatagccttgccaataaagctttcgccagatcgatatctaggatggatagttgttcgatcgcctcctctacacgttctcttccagccaaccaagtcccatagtggaattgccaataatcccgttccggccggggagatatttggatcgcccaacgaaaagcatcgtccagatcttccgtgccggatggagcccactgcccgtcttccggatagggggcggcgggaagcatggacttattcttataggcatcggctaaggcgatccagatggaagattcattcttccgggcccagtcgaatagcgggatgcgatcgatcgggcgaagccttaatgccggaacctttaaggaatagatatccaaaggatgatctgtcggtatccaatattctacgtgattctttttctcgccgggacgcaattcgagcttgatagattggtcgctgatcgggccaccttggatttctacgtaaggctgccggtcgggggtactgagcatggaccattccttgtcgccggctacgccataactccataatttgataccgggcgtactggattcgtcggcgatatgatagagcccgctgcccaaggagggagtgtaggccccgaaagcattcacgtctttcgttttccagaagtagccggtcatctctttgatatcccgttcatgatgggttccttccgttttccagtcgatcgtgtccaacgtggaggcatgggataatacggtcccgttcgggaaatcgtattgggtatccggtgcgcaaggaagggcggcgttggaccatgacatccatggataggcttgctttcccgggttgtagtaaacaaccctttgggtaaggcattcgtccttatctcctaaggaatattctacagaccattgcataccgtaatgagattcccgttctccgcatgttacatatgtgcggtctcccgtatgatcgatctgataaagcaccggctcattttgcgtgggagagtgggagatcgggaaactgacctcgatccccccggccacgaaatagaaacggggtaatatccgtgtgtatttgattacgtccggtctgtacaagacctccttgccgctctccttgtgagtgagggatattactttcccgcaaagatcggggcagatgatagccttgactttctcgttctctagcgagatcatccggtaccttttaggtaccggacgatttgaggtctcgctataactcatataggggtatacgccattcgggtccaaggcggtcggtagcgggccggtgggcgtcaatacgtgcgtcagctgtatctggtcgaactcctcgcaaacaacacctgttgtctgcgagaaggccggccctgcggctacgcttgccatgagtgataggattaaacgatatgctttcatgtctttcctgctatataagcccattatttcgccaaaagatcggacagttgacggatgatgaggttacccttacgtacatccgccgagatcttgttctcatcaaactctttctctttcgggaagatagacaaatgttggtccagctgcttcaataagccttgggcttgagcgttacccgattgggcggtcagttcccgtaggatacggactttctcgaaatccacgataccttctctcatcttctcgaagcggatgcaactcttgcctcccggatataccatgtagcaatcgcctgcagcccaagagccatgacgtgcgtcgcgatcggcgtcttctggccaagcgtcgtaagcccatcgcaagaagccgtcgtacccatacgccattacataccaactgatccaacgtccctcgataggaggtgagaacacgaagttgttcgggatcggcgggttacagcatacgtatacggtggacgtgcgtccggtggcggcccgtgccttttgctcggcgatggtaggttcctctccgtaaaggaaagaataatcgtccagcagtccgtccaattccttatgccaattgccggcgtaagtgatcttccagcatttatcatggttacgtacgacattgatagccgctaaggtctcttccatcggattctcgttgattccgatataggtgatgtccaaccagcttttagcttctagatggaacttgaaatccgtgaggaagatattccacatcttcttgaattcctccgagcttggcgcccagttgatataagaataatcgcccgtagcctcgtccttatagcggtgacggaatccccaaggaatcggggtatagagggtgattgcctcgtcgatgccacattccatcgctaattctacgtactcgtcgaagatcttgtagtcgaaggcccatgtgccgtctgctttcttgatccactcgatcatacccccctcgatcatataggagttatcggaccaaggagaatgtactccataagtcgtgatgtaggtaccacccgcatcggcataatgcttcaaatgctgcttgagaagcattttatgttctggtgaccacggttccacgtgattgtaccatgccacggcccacgggttctgccataggtccagacggtatttccagtctttcggataggggagcaactggttttgcaccacgatctccagattcaagaattgaggagccttgcctttcgcccgcacctccacctgtcctttatacgtgccgggaacggttcctctcggcacatccaccatcatccataccggacgggtggtttgggaagggagatcgaagcggtccagcgtctcgaaacggtctggcatcaagaagccggatttgtagggagattccccgcagatggcttttttctcggcatacggataattggacaatacgtaacgcaccaactcgaaggtaatccgatctttcggaatgatgtttccctcggcgctcctcaagtcctgcgtagagacacgtacttgttccaacgcttctgacgaccataccaatatctgggcattcgctctttcccccctccaaacggtcgtagagtaggaagatgataaatcgttgtcatggtttacgggtacttccttccggaaataaagccggtcggtcgatccgaaggcggaatggatacccgcctgattgctccaagcgggttcattcacgcaaaaatcaaatgttaactccgggtcatagtgatgactccgtacagggacaaacgtggaatccatctgccccggatacacttggcctagactgatatgagaataaataaaaaaactagctaccgctaaaaagtatttcttcatgctataaaaatttaagataattcatatttaaatgggattcccctcccagataggtaggccctcccttctcgtataggtagggcctaccctcatatatatagtcgcttattcttggaaaaacccttaccagcccggattctgttccaaggttcctttcgacaattgtacctgttgcaaaggtatcggtgacagccaatgtttcggtgtctggaacttgcgggcggacgcgggttgggcgatgataaagccatcgctatccacctgtatatcctgcccgatcaccaactccgggaatttctgttgatactccgtacccacgaatttcacgccacggatcgcaaggggaagaaccgtttccgccgtgccccaacgacgtaggtcgtcccgacggtatccttcgaatgccagttccacggttctctcacgccggatctcttccagcatattcagtccgttggcggagacgaaagcgttggttaggtgaggcatattcgcccggtttctcagatcattgatggtgatgtctaactgatcgtccgtgatttgtccgttcttctcgtataaagcctcggcgaggatcagcaggacttcggcgtaacgaaactccttgaagtcgtattcgccgatgaattgagcggcatccaatgtctcatccaagaacttacggatcatatagcctgtgcgtgtagcgctattccctacaaatcccggataggtaggtgtccagagacctccctcgaaaaagacctcgctaccgggaacgataaacgtctgctccatacgggagtcccggttctcgaattcactcgtttggtattggaatcccttgaataaaggggatttatcgatgggcagaccatcgttacataaatacatatccgcaaggttttttgtaggaaccatggcaccgaaccaaagttcccgtgtccagttatgggtcactctcaatttataataacgccttgccaataagacctccttgctatcatccccctctaagatatgtagatatttatagctttccttccctttatcccggaacaaggcgtattccttggaatccactagggcttgggcggcatcgatagccgattggatatacatatcggcattggagccttgatggtatttctcccaagttccctcgtacaaggatacgcgggcttttaacgctaaggcggccccttgcgtggtacggcccaattcctcggtagtcaactggctttgcttgggaagcaaaggaatcgccttatcgagatcgtcgatgataaaatcaatgatctcctgctgggaggagcgaggcgtgtaaagctgttccgaggaggtattcaagggaatctctatcttgggaacccctccgtagaacttgaccagtttccagtagttgtaggcccggaagaaataagcctccgccttccagcgtccgatctcgtcatcggtcaatccagactcctccgctttcttgagcagataggaagtggattggatgaatttccaaggctcatcccaatcatccgaattgaccggtgctaaataagaaccatcgcttacgtcgtccgcccccgaaccgaaagcgatatccgagttcttatctatatattgggaggcctccatcaggctgaagtagaaatcattggcggccaactcgaaatcggaaggcttttgccaaaatacggcgtcggacacttgatccataggtgtcatatccaagtcgcaactagatagcccgagtgtggccgatagcgctataattatattaaatcgtctcatactgctaatttgttttttcgtggaaccttagaaagttaagtcaataccgaaagaataataacgttggaacggataattgaatccggctttgtccgactcggggtcccatcctccttttacgttatgtatctcgaatagatcctgtccgcttacgtaaaagcgtgtccgttcgatgcctagtttctgtaacgcacctttggggagcgtgtagcctatctggatattctttaggcgaacataggcggcgttgatcttttgcagggtggatgcctgataattccaatgccggatctccccatgcgtcaagcggggataataggcgtccggacgatcctcgttccatgtctggccgtagtagaactggggcgggtatctccaccagtcgctccaaggcatggcgaagtctccttcacggaacaaggtgcgcttggcaactccttggaagaatacgctgatatcgaagttgttccatttagcgcccagattcaatccgaaggaatagcggggagtggtggagccaacgtattcggcgtcgccgtcatccccatctttatcaccgtaggtggagatcttaccgtcgccgttcaaatccttgaacttcgcgtctccgatgccgatattggaaggtacgccctctagtttcttataagcgtcgagatccgcttggtccttgatcacgccatcgtatacgtaagcgaaataggaattcatgggataaccttcccgggtctcgttcaatcctagtttataggtatcggcacctccgtattcaactaatttgttcacggcgtcggtcaactggaattgggcagagtattcaacgttgccgatcttgtcggtccagttcaatgtcaactcgaagccgttcgtgcgtaatttacccgagttcgagtagggtgcctccgcgcctaacatgctgggataagttaccggaattaacatattattattcatttttacgaaataatcaaacgagaagccgaggcgggaatcaaggaaagcggcatcgacacccacgttgacattctccagaatttcccatgtccggtctaccccggccaatacgtctaagcccatggcttggctttgggaaccgtttccgaacggatagattaatttagttccccagccatcgtccctaaactttagcaactggatatagtcatacaggcggataccttcttggtttccggtctgtccgtatgatgctcttaacttcagctcattgaataccttggagtttttcaagaagttttcttgcgagatacgccagctggcggagactccgggaaacattctccacctgttgccgggggcgaaacgggaactaccgtcataacggaagtttgtctccagaatgtacttgttcttaaagctgtagcctaggcgggcgaaggtagagccggtagcccaatgctcggctttggcgtcgttcttcatatttcccgtgcctccgaggttaagctcccacagctcatccgagatgaagttatcacggcgtgccatgaacatgcggacttcctccgtctcgtaggccatacctaacatggcgtccagatggtggtccgggccgaagttcttatcgtaattcaagtaggccgtgtaattttggtaaacggtctcttctgtcgtgcgatccacggcagactgctccggacttcccgctccggtgtagtaggtgatattattgtcccatgtataaagagggatcgctttcgctatatcctcattgttcttgttcttataattaacaccggcttgggcggttaaggtcagtccgtcgataatgttggcgattaacctgaaattaccattcatctcccgggtcttgaacgtggcggtctcgctctctttggccaacgctacggcattgctccagcctccttgggtgaagaagttaccatcggcattatagaccgggtggttaggcatatccagaatcgcctcaccgattacccacgctccgttgctgcctacatcggtacgtttattattgtccaaggctactttggtttccagctttaaccaatccgtgatcctataatcgtagttcatacgtagattatacttggtgttattgtcgtcggcatattttacgactccgaattgcttgctataaccggcggataaataataattggatttctcgccgccaccggagatagtgagattgtgcttatgctgaacgccgttgttcaacagctcgtccatccagtccgtgttcgtaaagaacaatttccatcctccatacaacgggtgatcgatcggattcgggtcgttggacaagatcctatccagaagctcttgcgtatacataggggcggagccgttatggatattggcctcgttgtccatgatcgccatctcataattggttggcgctttcatcataccggtcatcttggagatcgacaagtttccattgtaagtgatcttaggtgcgccggtcgctcccttcttggtcgtaatcaagacaacgccgcctgcggcccgtgctccgtaaatagaggcagaggcatcttttaagacggagatggcatcgatatcctgcggattgatcatattgatatcaccgggaataccatctactaaaaccagcggggcactgtctccgttagcggatgagactccacgtatgttcatcttaaagtcctcgttacccggttggccggagcttcgttggataaccattcccggtatttctccctgcaaggcggatagcacgttggtcacgggcttagattcgataacctcggaggtgactttcgagatcgctccggaaagattgcttcgtttctgtgttccgtaaccaatcacgactacctcatcaagcttctgggcgtcttcctttagctggatattaagggtcttgttgttgcctacggccacttcttccgataaatagccgatgtaagatatgagcaggatcgatttaccgttcgcctcgatgctatactcaccgttcaggtcggtaactgtccctttggacgtaccttttaccacgacgttcgccccgatgatcggttcgccccgttcatctgtaatgataccggtcactttccggtcttgcgtcactggaacggaggcgttgcccgcgtttccgagactgacggctatcgtgttattctctcgcttaaaataaagattggcttgccgggtgatctcgttcaatacgctgttgatgggagcgttcttgaactttaggttaacttgtacgttccggttcgcgatggcttctccatagaaaaactttaatcctgtctgcttcgacaaatcatcgaagactttttgtatgggttggttttttacttgaatcgttattctttctttttgattttcttgggcttgcagaggcttaggggagcttaacgctaaaaaaactaaaataatagaacaacacatccaattatacctagtaatagttggaaagttcataattttgtatgtttaaaggttgtttttatacacttttaaaaacagtccgatttatgtaatctccaagggggtccaatccaagggtgtacatatcgggaaagataaagggagatcgaaggtcagaggtcggtttcccttttttatgtggctaagcttatgtcgtatctttcatgggcaaatcgattttaaggttaataactcgttttgtataacacgatccggtttccttccgtccggtatcggatgccggttgaatattgaatcgcgttcagtacggctttcagacttttattgtcgtgctcgccatagatgtaatcgtcgaatacgctattcggatcgagtacgatcgcttgattatacatccgttccagatcatgtacaacgctactaataggtgtccggttaaaataaaggccgccttgcaaccatgccgttactttttggacgtcctcgttctttttaaggatctctccattcgcgttattcacgattacttgctcgttcggtaataggcgcattacgctttcgggcatatccacctcaacttttccggtccgaacgctgacggccatcaactcatcctcttgataggcttttacgttgaaagaggttccgagtacttttacgtcggcttgtcgggtacggacgatgaagggcttgccctcgtctctcatgacattgaaaaaagcttctccttccatttctaccaaacggatgtcagaggtaaattccgttgggtatcgcatgacggtaccggcgtttagatgaacgaccgtgccatcgggaagggtgacttgcttatgttcgccatgattgacgcttatttccgttaggagatggtcgctggcagatgtatgctgcttcgctgaatgatttaggtatagtttcgctccgaatccgatggaaacgataatcgctatgctcgccgcatacttgatgaaagtggatagggagattcttctttctcttttacgtgtcttatccaacaggtcttgcgcctccttcttataaagcagatgattatgggaatcggattgaggtaagtcttgcgcctcgttccagacccggtccatttcgctttctaattctgctcgctcggttatggatgaggctaacttccgcaaggtctctatatcgttccgtgtatagagtccatttacatatcggattaataaatcgcttatatatttgttttgttcttccattatttctcgtgctatattaatagtacaaagaagtccgggagaactgggatgtcattaacttttattagtatatgattttattatcttcgcgaaacgatatgtgatgctaaatgaaagagagacaaattataaagtcgttgaaagaaggagatagggaggctttttcgatgttgtataaacaatattgggaaaaggtttatcatttctgcgggctttatttgaataatcgggatgtggccgaggatgtggtacaagaggtgtttatcaaggtctgggagtcgagggaattcatccgggaggatgataacttcaaggggcttctgtttgtcatcacccgtaacttgatcttcaatcagcaccggaagaacgtgaacgaggacttttataaaatgacggtcttgtccgctatggagacctcctacgacttagaggaagagatcaccgcctataacttgggggagtatatcgatcatttgatagaggaattgccggaaagacgccgggttatctttaatctaagccggaaggagcataaaagctataaagagatagccttccaactcaatatttccgagaagaccgttgagaaccagatcagcgaagccttgaagttcttgaagaaaaatatcatgttacttatctggtttatctagcgctttcctaggtcacgtatttatagagtccggaagtgccactttcgtcctaagttttagttttgctcgtcttctttttcaggcagcacataaatccggtgtgttcgatatcctacgctggctattacgttatccttgataaattgcttgatatcctcgctcgcacggtagcgggtacaattgttcaagccggcgtaatcggtgagatttatatatgagtttctttctagataagataacatcttagccttccttccctcaattcccgttttgggcagattttcccgtttaaccaagatgggggcgttcttttttaccatctccttcagtcggggagagcagcggaagttaacgccgtgtatgctagcgcttgatttagtatttcctttctggtccgttacttctttgctttttaccgatggcgagaaatgtcccaatccttccagttccacgctgtacccataggataattccctgccgatataggaagtaagcgcctccaatacaccttttatgtcggcggaggtgacggatgagcattcggaaatatactcacatatatcgttcatgcgtttggtatctctggtgatgactcgtgcgcaggatgttggcccgcgttgttcattgcccggtgtattataaatactgacttggatgccacttcttggttttcccatgattttctcgttatttaaatggataatgtataggatgcctcggagatttaacgtttatctctttggcgtttctatttgatgaaatcggttgccgacgccctcggcaatgctgctgacgctgtcggaaatattgctgacggcgtcggaaatactgccgacaccgtcggcaaccaatttcattgaatacaaaggacggaaatataaggatggaaagcaaggaagatactgataaaatacaatttcgtaaagataattttaaagagtacctataagtaatggacatttaattgtacttgaggctttaggcatgattatttttcaatcgtatttgggtatcttatctgaatttgattaacctaagcgaatttttttatcttccaataggggggagggagtcgtggcgtgtatttataaatagaacaagaataataaacatgagcgaagatacgagaacgatattgaagaagttgatgcgagatgctctggatgagaaagatcggcaacgtttgctgtgtgacccaaaagtggaagagcgtatgcgttcccaatgggacgaggctgcggatcgcgtgaatcccgtggtggggaatcgcatgtgggaacgaatcatagcccggacaatggcgacaaacggtgtccgtaaactctgggtctataagattacggcgatagccgcctccatattgctacttttaggtgtaggaagcgtagtttattggtctcatacgaaagaagatcaatatatatatgtaatggcctccggtgtccgttgcatagagtcggtttccttatcggacggcacgaccgtgagaatggggccgaatagccaattgatctacccaaagagtttcgatggcaagacccgtgatgtggaattaaaagggcaagccttcttcgacgtggcgaaagatcgggaaagaccatttaccgtgcataccaagaacatggatgtaacggccttgggcacggccttcgaggttttcaattatgattccgagagcaagttggagacgatcctgttaaacggtaaggtgaagattggcttgggaggtcccaatgtgaagaacaggcgtgaggtgatattgaacccgaacgagatgttggttttcgacaaacaagcgaataccgttagagttaagacggttaatgccgaggagtattcgggttggcgtaacggtgtcctcagttttgagaacgaacgcttgagcatgatccttacccgtctggagccttggttcgggcggaagataaagtgcccgaaggagatagcggagaaatatcggtttacgtttaaggtacgggatgagtccttggagcgaatcctgtttatgctgagcaatacgtcgcccattaaatacagagagaaagacaatgaatatgaactatatataaagggagataaatgagtgtctaacgttaaattctaggagatatgcttgttaacagttcttgagtctaataaaaaacaggaggaaaaactaggtttctcctcctgatcaaatgttcttgacggcaggcgttaggagttgagaggccgacacacctgctaatttattcatcagaaacattacaaagttatgaaaaaaatcagaaaagtaaaccgagtcatgaagataagtgcgttgttatccttggctttcgcatgcactgtatccgcttctacctatggacagaattataagctttccatgaataaacaggattgcagtatatcggaagtgctaaaagaaatagagaaaaatagtgagtacacgttcttcttgaatgataatcaagtaaatgtaaataggaaaacgagtgtaaaagcaaataatgcttcgttagaggaggtcttagagcaagccttgaaaaatacgggataccaatatgagattgtagaccggcagattataattaagtcaaagagtgtttcaagtgtctcacatctgaatgccttattccagtcttcgccacgaaagattaccgggcaagtaaaagatgccttgggagaacccattatcggggcgaatgttgtcgttaaaggcactacgaacggaacgattacggatattgatggaaacttcagtctggaagtaccggacaatgcgatcttggtagtttcttttattggttatacggatcgtacggtcgaggttggtaattcttcgaaagtaatggtcagcctgtccgaggatacccagaagttggatgaggttgtggttgtaggttacggaacgcagaagaaagtgaatttaacaggagcgatctcctctttggatgcggagacgttggagaatcgtccgatcaccaactcgacccaagcgttgcaaggtacgcaaggtgtttacgtaaatcaagcgggtgctcagccgggagcggacggggcgacgattcgtattcgtggtcagggaactttgaacgataataacccattgattttggtggatggtatcgagttcccgttggaagcggtaaatccgaatgatattgagagtatttccgtattgaaagatgcggcttcttccgctatctacggttctcgtgcggcgaatggcgttgtcttggtaaagacaaaggggggaaagaaaggtaagtttaccgtcgattataataactatttcggcgtgcagcaggctacctatctgcctaacttcgtatatgatccggtcgtgtttatggaaatgagaaaccaagcgcaacggaacgaaggtaaactaacggtggattattctgatgcgttaatcgaggagtacaaacaaggtatgttaacagacccgattatgtatccgcagaataattggttggatattatgtataataatgcctttattatggagcataacatgcgtttctccggaggtgatgataaatatacgtattccgtatctttaggctatggtgatcaaaatggagtattgcgtggaacggattccaataaatataccttagctgtgaatacgactgctcaggtaaatagccgtttgaagatcggcgctaatatcaatgcgcattatcagatctataatgagccggtagcgggtgtggcaaacttagtggagatgacttataaagcgcaggctttccacccgacttatacggccgatggtcgctatgcggatacctttatccgtactcctgggcataatatctatcgccatccgttggcgttggccgatgagggcgagaacaagcataagtccttgcgtatgttggcgaatttgtctgcggaatataagcttccgtttgatatcgtttataacttgaatgtcggtttaaacaaatatgattatctgcaatctcgttttgcgcctgatgtatacgaatatcagttgaagaccaatgaggagaaacgagtggtttatgacggtcagaatacacgccatgcctataaaggtgataagaatgacttggcagttacagtattcaatactttatcttggggcaagaagttcaatgatgcccatgacgtaaaagtattggctggctatagttttgagagcgatgataagactgagttttccgctaaggtagaaggtttcttagggaacgagttgcacgaattaaacgcaggttctagtaatccgagtgtagcgggtacttcctcgagatcagtcttgatgtcttactttggtagggtgaattatggttataaggaccgttatttatttgagggtaactttcgttatgatggttcgtctcgttttgccaaaggaaatcgttggggtattttcccatcattctctgccggatggcgtttgagcgaggaagagtttatgaaagatattccttggatctacaatctgaaattgagagcttcttggggacaattgggtaacgagcgtatcgatttgttccgttacgtggacctaatgaacttgaaggtgataaaaaatgatggttcaattacggattataactacccgttgaatggagcgatgcaatccggagcggctattaccgcctataacgatccgaacatcacatgggagacaacgaccatgacgaatgtcggtattgacgctagcttgttaaacggaaacttagatttctctttcgagttctttgataaacgtacttccgacatcttgcgtaaggttactttgccggatcaagtaggtggtctggatggcccgatccgtaatatcggcgaggtgagcaataaaggtttcgagttgaatatggggtatcggaacaatatcggggacttccgttacgaggtaaatggaaatatgacctttatcaagaataagatcgttagcttgaaggggcaaacaatcattgatggaatgtttatcttggaagaaggaaagcctatcgattcttattatatgcttcatgctatcggtattttccaatctgaggaggaaatcaagaatagtccgtatcaaaccgcggctactaaaccgggatatctgaagtttgaggatacgaatggagatgggaaaattaccgaagatgaccgccagatacgtggtggtgtgattcctaagataacttatggattcaatatcaacttaggatataaggattgggatctgggcgctttcttccaaggtgtaactgatgtctatacatatggagaccgcattggtgctactcctttatggtttggttgtggtttgccggaacaatggttgacggatgcttggactcccgagcggggaaccagcgctacattgcctatcttgactacgtatgaaggatgcttgaacgagaatttccgtacaaatgatttctggttgagaaatgcctcttatttacgtttgaagaacttgcaactttcttataacgtaccggcctctttcttgaaaagcggtgtggttaagagattaaaggtctttgtcaatgcgcaaaacttattcacgttctctccgatgaaggattttgatccggagaagaacttgaagggaagcaactggtatgcctatccgtctgtacggacttatacggcaggtgttaatgtcacattttaaataataaggaataataatatgagacgtaaaatatataagatgatatgtgtcgctgtcgcttgtatgagtttaatcgcttgtgatagctggttggatgtagatccttccgatcaatattccacggaaacattctggaagacaaaagagcatgcgagcgccggtataatgggatgttacaacgcattgaaaccttggcgttcattgcatacgatggaattcgatatgctgacagcgaatgcgatgccttataacgaggcgaatggtacgcaagcgattggaaagggtgaacatttgtctactacggctctaatcggaagtttatggaagaactgttacgttggtattggccgtacgaatactttcatcgctaatgtcggaggtgttgatatggatgagtcggagaaggcgaagatggtgggtgaagccaagttcttacgagctttctattatttaagtctggtcgataaattcggaggtgtgccactgattatagatgctcccaatgcggatgagcaagccgaattacctcgcaattccaaggacgaggtagtgaatcagattgtcaaggatttggaggaggccgctgccgtgctaccggacacctatgctagctcagacttgggacgtgcgacaaaaggtgccgcattagcgttaaaagcccgtactttattatataattctcgttgggcggaggcggcccaagctgctaagcaggtaatggagtctggcgtttatcaattattcaatgattatcgtcatttctttagcgaagataataaatataattgtgaggtaatctttgatatagaagcgaaattgccggagtatccaacggattatgatcagaatatctggcgcttgaatcgtccggctcccttgaaggaactggttgatacatatctctgtattgacgggaagacgatagaagagtcaccgctttatgatccgactcgtccgtatgagaacagagatccccgtttattgaaatcgatcgtttgcatcggttatccgtatttaggaaagacgatcacaaaagaagatgtggcgactacgggtttcggtgtgaagaaatacacttcttatgaggatgatgtaacgattcctttagtagaacgttcggctttcaatttcattttaattcgttatgcggaagttctgttgacgtatgccgaggcgcagaatgaggcgagtggtcctgatcagtcagtttatgatgccatcaaccaattgcgtaggcgtccggatatcaatatgccggaagtaccaaaaggtttgacgaaagatcagatgcgtgaggtaatccgccgtgaacgccgtatcgagttgacctttgaaggactctactattcggatatcttgcgttggaaaaccgccgagaaagagaataatggtatgatgcataattatgatggaatagaagtcgtgaaacgttcttttaatccgaaacgagattatttatggccgatcccttataaccaaacagtcttgaaccctaatttggagcaaaatccgaactgggattaatttttggataaattaaaaactgttatctttgaagtgccaaacacaggatggcacttcaaagccaatatatcaataaataatatcatgaagaataaactaatgttactgacggccgcctcagccttttcaatggcaggcatagccgctgattacacaaatatcgttctaattaatttggatgatgcgggttacggagatttttcttttaatggggcttacggatataccactccgaatatcgacaaaatggcggcggaaggcgttcgttttacacacttcttggcgggacagccgatcagtggagcgtctcgtgccggcttgttgaccggttgttatccgaatcgtatcggtttcgccggcgctccgggaccggattcgaactacggaatccatccggatgagatgacgatcgcagaggtattgaaacagaaaggatatagtaccgctatcttcggtaaatggcatttaggtagccaaaaggaatttcttcccttgcaaaatggcttcgatgagtattatggtttgccgtattctaacgatatgtggccattccacccgcaacaaggtgaggtctttaatttcccggatttgccgacttatgacggaaacgagattatcggttataatacggaccaaacacggttgactacggattataccacccgttctgttaatttcatcaagaagaataagaataagcctttcttcttgtatctggcccataatatgccccatgtaccgttggccgtttccgataaattcaagggaaagagcgagcagggtttatatggcgacgtgatgatggagatcgactggagtgtaggtgagatattcaagacattgcgtgagctgggcttggaagataatacgttggtgatcttgacttccgataatggcccttggaccaattacgggaatcatgccggttcagccggtgggttacgtgaggcaaaggctacgacctttgatggtggtaaccgggttccttgtatcatgtactggaaaggtaagacgttaccgggcacgacttgtaataagttagcttctaatatcgaccttcttcctacgttcgccgagatcacgcaggccccgctgcctactcgcaagattgatggcgttagtatcttatcattgatagagggcaagaaagacgcgaatcctcgtgaatcctttgtctattattataacaagaatgacttggaggctgtcacggacggtatgtttaagctggtattccctcataaatacgttacttacggggcttatgagccgggaaacgacggccagccgggtaagttgacgaatctggagatcatgaaacctgagatgtatgacttgcgccgtgatccgggagagcgttataacgtgatcacccagtatcctgaggaagctgcgaagttgatgaagatcgccgacctgaaacgtcatgagttaggggataacctaacgcgcgtaaagggaacggagcgtagggaaccgggcctagtacaagggaaaaaacgtcatgacctatgaaacaatcgatcataagtatcggaatgactgcctgttgtctttcgggaaacgggcagttcctctttgccgccgataaaccagtgcaagaggaacgtcctaatatcttgtttatcctttcggatgatcatacttcccagtcttggggcatttacgggggggtgttgggggaatatgcccgcaacgagaatatccgtcgcttggctgcggagggttgcgtattggataattgtttttgtacgaactcgatctcttctccgagtcgtgcggcgatcttgaccggagcctatagtcacgtgaacggtgtctacacgttaagtgattcttttgatccggagcaggataatatcgccaagcaaatgcgggcgggaggctatcagaccgctttggtcggtaaatggcatctgaaaacgcaaccgcaaggtttcgacttttattccgtgtttcatgaccaaggcgagtaccgagaccctacttttataaattgtacggaaccttggccgggtgagcgtaatttcggggagcgggtacgaggtttctccacggatatcgtgacggataaggcgatccgttggatgaaagaggccgataaggaccggcctttcatgatgtgttgtcatttcaaggctacacacgaaccttgggattttccggaacggatgaggcatttatatgacggcgttgttttcccggaaccggaaaacttatttgattgggggccggagacgaatggacgtaccttctccggacagcctttggaggagttggcccgtcgttgggacgtggcgtcgcaagaccctgataaatggtggtgccggtatccggagttgccttttacgacgaagggcatgcatcgatctgccgcccgtagcggcgcttaccagaaattggtgcgcgactatctgcgttgcggggctacgatcgacgataatatcgggaagttattgaaagcgctggacgatatgggaatcgccgataatacgatcgtggtgtacgtatccgatcaaggttattttttaggagagcatggtttcttcgataagcgtatgatgtatgaggagtctctacgtatgcctttcgtgatccgttacccgaaagagatcccggcggggatccgcaataaggatataatcttgaacgtggattttgcctctttgctggcggattacgcaggcgtgaagaccccgaaagaatcgcagggccatagttttcgcgataatctgaaaggaaataccccaaaggattggcgtaaggagatgtattatcgttattggacccaacattcgaaccgtccggcccatatgggtatccgtaatgagcggtataaactgatgtttttctatggcgaccgtctgaatatgactggttcggaggataagaccacgacaccagcatgggagttttacgaccttcaatccgatcctcgtgagaatcacaacgcttacaacgatccccaatgcgccaagatcatccggcaaatgaaggaggagatgctgaagctgcggaaagatgttaaggatgaggacacgaatacccctaggatgaaggagattatggatacctattattggtaaaaagaaagcggagggagacgtagcgtgctgcgtcgcctatcctttgtaatagaagtccacgctagcaaccgagagggagtgtggtatgttataaagcatgtatttctagaaagaagaaggaatttgttcttttgtgaaaaagaagtcttatgtttgtgcacgatatgaaaaacagggtttatgtggccccgttatcagtaaacaaccaaccttgacatgaatacaaacagagataaggctgtctcttttgggcgggacggcggagatgtccgccgtcctgtttttttgtcaatgagccagagctgtacgtgacatccgttccagctccgggggagccagagcggaatatcgcccgctggctgtgtgaataatgacaagctgcgtctccccggatacctatttcgttaactcataagcctctatcacgcactccaaagcgcaggcgtttgctgccgagctttccttgtggaaagggccgtaccaataacaaccgaagcttttggatgtggggtcataatctttcgtgatgatggattctgcgtttttcaagatgaaatctttataagccggattctttgtcacttcatacaggaaggctaaatgacggatgaagatacccttaaattggacaccgtcgttgctatcatcgatctcgggcttcatctcacgaagtataccctcgtcggttaccaattgcgtggtaatggtagcgtcggcgatcttttccgctagctccaagtaagatttatcgttggtttggagatacatctcggctaagacagcgatggctacgccttggttatacgtgtagtgggcgttgcggttgggggtacaatcgtctttcgtgccgtcctcgatttggtagatgtccgtattgatcatgccggttcgcgtataccaatccacgttcttcttgaaccagtcgagatacgccggattttgggtcgctttatataatcggatagctgtcagggagaacaggttgttcgctatggagttcttgtaatgcaaagggttctttttccagaagatgccacctccgcaagcgtcgctccagccagttgtcatatcatcgaatatgatctcggccatatctaggtactttttctctccggtcagtttggaggcctcgatccatgccaatgcccaccaaccctcgtcatcgtaataatcattgatgaagttgtcgcaataacggggagtaccggttgagtctacgcctacttggtaatgacgggctttctcgaatacatcctctatgacagatgggatggccggatctttggttacggcgccgtagcgaatggtggcggtcaatacgttcgccgagttccaccagccggctgtttcccagataccggtcgtgtcgtttctccagcttagggaggtttgtacgctttctcgcatctttccctcaaaaggggaaggtttgctacaggatagcatgaaaaatacaagcaatacgcttgtcaggaaatgtttgtacatacgtatttatgaaaataagattagattaagccacaaagataaatgatctttttgaactttagttaaactttgtacctttgtctgacggaatctaagatacttcaatattaatcataaaagaaaaacacggtaagatgaaaaagcaaatcttatttatttgttgtgcggtaatcgcatactgcctgagcgcctgtaatacggcacctcagcaagcgcctttgaaagagaagaatctgccaaagcatgtaatcttgatcggtttcgacggcttgagcgcccattgcttgaataatggggcggatatgcctactttccgtaagatgatggcggaaggcgcctccacgttagagaatcgttcgatcctgccttcgtcgagtgcttgtaattgggcttccatgtttatgggagcgggaccggagttgcacggatatacggagtggggatctcgtacgccggagcttccttcgcgtgtcgtgaatagcgacaaccgtttcccgaatatcttcggcctgtaccgggataaggctcccgaagccgagatcggctatatctatgagtgggaaggcatgaattatctggtggataccttggccatgagcttccgtaagcatgccccgatgtcggctgagaacccgaacggatgtaccctggtagccgttcagtatatcaaggagaagaagccgaacctttgcgcgatcatatacgatcagccggatggtaccggacatggcaagggttggagctccccggagtatttcgcgatggtgaatcatttggacagttgcttgacgcaagtgatggacgccgttcgtgaggcgggtatcatggatgatacggtggttatactgacggccgaccacggcggtatcgagaccggtcacggtggcaagacgatgaacgagatgcaaaccccgatcgttttctatggaaagaacgtaaagaaaggcttcaagatcccggagagtacgatggtatatgatatcgctggcacgatagcttgcctcttggacgtaccgcagccgcaggtgtggatcgcccgtccgatattatcagctttcgaggataattaaaaacatagatcatgaagaaagttatttattcttttatttttcttttttgcgccgtattaaccttacaggcggagacaatggtggttgccacctataatttgcgtaacgccaacggcggcgattccacgaacggtaacggttggggacaacgctatccttacatcgcccagatcgtacaatttcacgggttcgatatctttggtacccaagagggcaaatatccgcaattgcaggacttgaggcaagccatgcccggatatgattatatcggtgtgggacgtgacgatggtaagcgggcgggagagcattcggctatcttttaccgcacggacaagttcgaggttttggagcatggcgatttctggctatccgagatcaccgaccgtccgaataagggctgggatgccgtccttccccgtatctgtacgtggggtgagttccgggataagcaaaccggtttcactttcttgttcttcaaccttcacatggaccatgtaggcgtacaggcacgtgccgagagcgccaagctgatcttggagaagatcaaggagttccccaagaaacttcccgctatccttaccggcgatttcaacgtggaccaaacaagtgagtcctatcagttgttagatggttccggtatcatgcgtgactcttatgagatcgctgatttccgctatgccccgaatggtaccttcaacggtttccatccggaccgcaagaccgatagccgtatcgaccacctttttcttacgaaagaatttgaggtgaagaagtatggaatcttaacggatacttatcgctccgaggcgaaagaaagcgcccggaaggagcaaaacggtaatttcccgaaagaggtgtcattgagtaaatatgaggcccgtaccccttccgaccactttcccgtaatgatcgttgtggaagtaaaagactgaggttttagaaaaattggttattattaaccccgtaatctttatcaaatttgtttagatcttgttatataatcagaatattgactaaaacgatctaaacaaatttggtatgatacgtaaattattgattcgtgatttgactcttcgcgatggtcagcaatcggcattcgctacaagaatgtctcaagcgcaaatagaccgtgtacttccttactacaaagacgcaggcttttatgccatggaagtatggggtggggcggttcccgattccgtgatgcgttatttaggtgagaatccgtgggatcgtttagagatcatcaaagagaaaataggaaattcctccgagttatccgctctttcccgtgggcgtaatttattcggttataatccttatcccgacgagattatagaaggcttttgccggaactcgattcgttccggtatcgatatcatgcgtattttcgatgctttgaacgacgtggataacgtgaaatccacgatccgttatgtgaagaaattcgggggaaaggccgactgtgccatctgttatacgatagatcctcaccattccccggtagaacgtataaaagccgccttgcatggacggcccttgcataagcctgtttttacgaatgagtatttcttaaacaaggcccttcaactggagtcgctgggcgctgatatgatcaccctgaaggatatgagtggtttgatacctccggctcgtacggcggaattggtgcgattgttcaagaagagcttgaaagtaccggtggatttccatacgcattgtacgcccggttacggattggcgtcggtcatatccgccattatcaatggggtggatatcgttgatacgaatatatggaacttcgccggaggaccagccgctcccgcagtagaactggtctatatcttctgcaagaaattgggtatcgagctggatcttgatatggatgcgatcgctaagatcaacaaggaattattgacgatccgcaaggaactttccgcattcgataccgctaagaaattcccaaggccctttaatcccgtagaggatagtttccccgccgagatcgaccgcttcttcaacgatgccatcgaggccgctcggaaagataaggaggacgatttgctgctttattgccgtgcgatcgaggagtattttgatttccccgagccgaacgagttggtgaaaaaagcgcagatcccgggaggtatgtacacaaatatggttgcccagttgaagcaattggggcagatcgacttgttggagaaggcgatgtcgctcattccgcaagtacggatggatgccggcttgcctccgttggtgacgcctacgagccagattatcggggcgcaagcggtttcctgtgcgctggatgagctgaaaggccgcccgatgtatagtaatccttccaaccagtttatcgccttggtaaaaggagagtatggcaagacgccgattccggtagatccggcgtttcggttgaaaatcaccggcgtacaaaatgaggtgccttacgacggttcccattacgtgatgcaagagaatcctgtattggaggatttggatgtgttattggctgagaatgagaaagaaatactgttgctggagttattcccgacggtagcccgtacatttttaactaaatggaaagaacaaaaagcgagatcgaatgtttaatagtagaaagtcttcaaatttggcatccgtcatctattatatgtacgttgccgtttaaacggtgatacgaaaaggctctccgaatggtaagcgaaccatgggagagccttctttattctataaagtgactttttcgcggactttacaaagggatcttgtctatacgacgttggtggcgaccaccctcaaaaggtgtatccaagaatatctcaacgattttcttagcctcttccttgctgataaaacgaccgggcattgataacacgttcgcgtcgttatgctcacgtgccagtttcgcgatatcctctcgccagcataaggcggcacggacaccccgatgtttgttcaaggtcatactaatgccattccctgtaccgcagacagctattcccggataaacctcgccagcttctacggccttgcccatcagatgggcgaaatccggataatcgcaactgtcagaggaataagttccaaaatctttataagacaatcccctttcatcgaggattgtctttatatattcttttaactcaaaaccagcgtgatcgctacacaaacctactatacccatctttatgctaataattcttttacttggttataaacgttcttagccgtgaaacctaatttctcgtccaatactttgtaaggggcggagaaaccgaaggattcaagtccccataccttgccgttaggacctaccaacccttccagattaaccggaagaccagcggttaagccgaaaatcttgcttcctgcgggaagaatggattcttggtactctttgctttgtgaacggaatagaccttcggaaggtacggaaacgatacgaacctttatgccatcggcacgaagcagggcggcgccctcgaccaaagtcgatacctcggaaccggaagccaaaagaattacatccgcattagcgtcttcattgacgatataggcacccttttccgcttgcaaagcctcttgatagcggttttccttagcgggaagatctgtgatattctgacgagaaagaatcaatgcggtaggagtgtaaacgttctccatcgctagtttccatgcgactgttgtctccacaacgtctgccggacgaagtaccaacatggagttgtgtcccttatgattcttcaatttctctaataaacgaacttgagcttcttgctctaccggctcgtgcgtaggtccgtcttctccaacacggaaagcgtcgtgtgtccagatgaacttaacgggctgctccatcaatgcggccatacgtaacgcaggcttcatgtaatcggagaatacgaagaaagtaccgcaagcggcgatcacgccaccatgtaaagacataccgatacagatacaagccatagaaagctcggctacacccgcttggaagaaagctccgctaaagtcgcctttcacgaaagcatgagtctttttcaagaagccgtctgtcttatcggaattggaaaggtcggcggaagctacgatcatgttttctacatgggtagcaagcacacctaatacggtagcggaagcggcacgggtcgcttggttcgctttctgctcgattgcggcccagtcgattttaggagccttaccggagaaccattgctccatcttagccgctaagtccgggtgagctttcgcccagacgtctctcacggcgtaacgctcggcgacgattacttccagttctttcgcacgtttggcatataattcggctacctcaggaaggattgcgaacggatgttccggatcgcctcctaggttcttgatcgtatctgcgatggaagctcctgccgcggataaaggttgtccgtgagtagataccttattctcgtaacagctgttatcagcgccgacagcacctttccccataacggtgttaccgatgatcaaagtcggtttggagatctctgccttagcctcttttaaagccttgcggatctcgtttacgtcgttaccgtttatttgaatgactttccagccccaagcctcgtatttcatggctacgttctccgcgtcaacgtcttctaccttggtagatagctgtacgttgttagcgtcgtagaacatgatcaagttgtccagtcctaaagttccggcgatacgtccggcaccttgggagatttcctcttggatacctccatcggaaatatatgcgtaaatagtctggttcattacttcctcacccagacgtgctttcaagaatttagccgcgatagccgcacctaccgcataagtatgtccttgtcccaacgggccggacgtattttcgataccacgcataacgtctacctcaggatgtcccggagtaacgcttccccattggcggaactgttgaagttcatccaatgtgaatttgccgcttaaagccagtacggaataaagcatcggagacatatgccccgggtcaaggaagaaacgatcgcgtccttcccatttgggattcttgggatcgtatattaagaactctgagaacagtacgttaacaaagtctgcaccacccatagcgccacccgggtgcccggagttcgctttctccaccattgacgcagccagtatacggatgttatcagctgctttgttcattacttgaatatcgttcattttatcagatgaattatttatttgactgcaaagataatcaaactctttgtaagagccgttatatcaatcaaacaattccttttcggtaaaggttcctatcttcttatatttttgataaattgagagatatttaagatagcccgctgagcgccttattcttgcgggtatacatcattcggattagagcgagaagtcgaaaccctgttcaacccatttgttgtattttttctcgttgaatttgtagaggaaagctcctcgtttagaacttttcttgtctttgatatccagtttttccagaatatccatggcgtttagctttttgcggaagtttcgtttgtctaaaagggtttggtagatggcctcatacaatgtctgtagttggggcaaggtaaattgctcgggaagcaaattgaaaccgatagggcggcttgccgctttctttttaaggacggacaacgtatcgtttatcatttggttatggtcgaaaatcaagtcaggaagctcggatatcttggtccaagtagcgttatggttttccaagatctcgggactaaaatcattcatattcaccaaggaatagtaagctacggagataacccgttcccctaagtcacgtgatacatctccgtaagcccctatttgttccataaaaagatgctcgatgcccgtgcaatcggttaatacccgtgatgctgcttcatccacgctttccccggatttcacgaagcctcccataagagaccactgtcctttcatcggctcgaacgaacgtttgtataataaaacattcaactccttattgttaaaccctagaatgatacaatctacggcaacatagaattttacttcgtcttgataaaaagctgctgacatcgttttatggattttaaagattaacagagcttgcgtgctccgtcgctgattactacattatataatttaggttcacggccaaacttctctttataagcggagaaggctttcttcacgaaatcgtcgtacaactcatccttaaccaagttgatcgtacaaccgccgaatcctccacccatgacacgagaacccgttacaccacattccttggcgatatcgttcaagaaatccagttcctcgcagctaacttcataaagcttgctcataccttgatgcgtgccgtacatcttttcgccgacagtctcatagtcgcctttctccaaagcggcacatacgtcgagtacacgttggatttcctcgataacatattcggcacgcatgtaatcctctgcgctgacatccgcttttacctcgttcagcatctccatcgtagcgtcacgtaagaactctactttcggatggttgcggcgaatggcggctaccacgttctcgcaggatttacggcgtttgttgtaggctgaggacgccaactcatgcttaacgaccgaatccaataacacgagtttgtaaccaaccggattaaacggataatatttatattccaaagaacggcaatccaagcggatcaaacttccggccttgccgaatacggaagcgaattggtccatgataccgcaattcacgccacaataattatgttctgtagcttgaccgatcttagccaactcgaatttatcgatattcaatgagaataagtcattcaatgcgaaagcataagtactttccaatgcggcggaagaagacattccagcgcccagaggcacgtctccagcgaatacggtatcgaaaccttggatattaccacctcgtttaataatctcccggcatacgccaaagatatatcttgcccagcttgcggaaggagcgtcctcctcggtcaagccaaattcagcgtaatcatttaagtcgatggagaacgcccggactttgcccgtcccattcggtttgatctcggcgatcatccctttatctacagcacccggaaaaacgaaacctccattataatcagtgtgttcaccgatcaagttaatacgtcccggggatgtgtataagctaccttcggtattaaataactctttaaatttagttctgattttttgttgcatgatacttaatttgattaaggtaaataattgaataaacaagaagaaattacccattcagataactctgccggataatttcttctttatcatattatgtcctgtccttattattcaacaggaatgtctttgtttacgttcttgctaccgatcaaagcgtaatatagcaaatatgccaatcctaggaataccacccagaagctagtaatgaaaccgccagcgtcggctacagctccttggatcaacggaagaatacctccaccgcaaaccatcaccatgaagataccggaagcggctgccgtatatttacctaaaccttctactgccaagttgaagataccaccccacatgatggaagtacataaaccacaaagagccatgaacatgattccaaccggaacctcaaccataccgaaagagatatcagacaagaatacaggcatactaacttttgtcgtagcaggggcgaagatagcgatcaagataaagatcatacctaccgtggcggctgatgacaacatcgccttactagagatcttagctccgaaagaggcaccgaacagacgtccgatcatcatcaagaaccaatatgtacccacgatagaaccggctactgtaggatcgataccgatctcaggagaagtagcgaacaagttcatgaagttaggaatacctacttcgacacccacatacaagaagattgcgatggcacctaaaatgaagtgacggaaagaaagcgcgctgtgcttgtccggagtcttggcttcattttccttaaccatatgcggttccggaatttgcatgcagaacaatacgataaatacgatggcaaagatacccatagccaagaacaatgccgggttagcgtcactgatctgagccttagcagcgtcaccgatcaaataaccaaccaataccggaacgatcgtagcgccgatagagttcacggaaccggcaacctgaattaattggttacctttgtttccaccaccacctagcgtgttcaacatcgggtttactacggtattcaacatacacatagagaaaccggacacgaaagcacctgtcaaataaacagcgtagctaccagccacaccggaaagataagaaatacctacaccacagaaacctacgatgatcgctaacaaagcggttttcttgtaaccgatcttctgcaatagcataccggccggaatacccatgaaggcataggcgataaagttagccgcgttacccagctgcgacatgaagttgctggcagcgaactggttcttaacgatgataccgaatgggttctgtagacccgtcacgaaagatatcatgaagaagagagccaccatcatgataataggcaatgtgtaattcttttttgctgttgattccatttcttttttgttgttttagattattagattacttaaattattctcttattctacactgaatttataaatagtagtactttggaaaacctcgcccgggcggagttccgttgtcggatattccggtttgttggggctatcggggaaatgctgggtttccagacataaagcggcccgctccgggtagcgttgtccgttcttaccttcgaaattcccagtcatccagttacctgtgtataattgcacgcccggttgagtcgtataagtttccattacgataccggtcttgggggaggagcagcgagcgcagtaagaaagttcgttgtcctctttatttaatatgtacgtgtggtcatatcccttaccgaatataagctgttcgaaattgtcattgattcgttcgcctacctcatgaggagtccggaagtccatcggtgtaccttctaccttctctttaggtccgtacgggattgccgtattgtctgtaggcagataatagtcggcgttgatcgtgagaatatggtctcctatataagggtctcccgcaccggataggttaaaataagaatgattggttagattcaagaccgtaggtttgtccgtagaggcttgataggagataacgacctcattctcatttgtcagatgataagttacggttgtctttagttctccggggaaaccttcctcgccatcggcggaggtatatttcaactcaatggtttgctcgtctatttgtttggcgtcccatacgaccgcattgaatcccttgattccgccatgcaagctattggggccattatttatggctaatttgtcataagtaataccgtcgatcgtgaattttccagcggcgatacgatttccataacgaccgcaaatggcaccgaaataaggttcttctgatgttaagtactcttcaatcgaattatggccagtaacgacatcggtcatttttccgtttttatccggaaccatcagcgagacgattttcgctccataattcgtgatcgctagctctgctccaaccttgttacacagggtataaagcgccgtttctttcccgtcaatttgcttgctgaagttagcaacagacaagcccgacagtgtatttatgttcttcatgcgtatcaatattattgaaattgcgtgtaaaagtaactttcttctttgtatttataacctttctgaataatgttttatagcatgattttagatttgtctaccaaaaatatataattatcgcttgtttatacgtcaagtccttgattcttctcttaggctaaaaaacaaaacaactcttgtcttacccctgttattagtaaaacagagatagaaagaaattgtccatgcggtcgtcctataaatatatcatactcatactctttgtgcttatgcccggcttgctttattcccaatctcaagattgggtacgtaagtccatttatccgcaagcggatagtggtaaaagcaagatctataattggatgtgggggaggcattatcgtcacctttatacgatcccgatcagggttccttcggctacgatagaaacgttggggggtgggatggatatcgtcgggcaagcggaagggtttcacggattattgttggagaataagcgtaagcaattgtatttgctaaagcccttgggtggctctacaagtttcttggagtcgaagtttttccgggaaatatataataagactgattttaagaatacatatttggatgagttcttaggagatgcttatacgattatcaatccctatacctttttggtcgcagattatttagcgaagtccgcgggattgagtttttctccctcccgtatttactatattccttcccacatacggaaagacacagttgcggacggcagcgatatacaagataggctggtcaatctaatcaatgttccggatattaatttaaggtctaatttgtataccacggaagactttctagacagccttcaagtgagtaaaaactatatggcggatcaaaatctatacattcgggaacgtattttcgatatgtggaccggagattggaataagacgaacgaaaactgggagtggcagtcacataccgtcaatgatagcgtaatttataccccgatcgtgatcgataggaatcatgctttcacgaaggtggacggagtattgttcaagcaaatgttgaagatattatcgttggattttatctgtaattatgatagcctgattttaaaagatacaaagaaaatcaataagctagcttttgcgctggatatggcggtagcaggccgcagtgatgagtcggtttggatacgccaagcccaagaaattcggagacagatgaccgactctttgatcgatagcgcttttacttatttgccggaaggtgtaaaacatgatgagatagaactgattaaacgaaagttgaaacgaaggaggctagagttggaagcggttgccagtcaatattatcgcttattgcaacgtacgccagtggttgccggaaccaatcaatccgattatttcttgatcgagcggcaagcgccggaccggactgttttacggatttatgatcccgagaccggagactgtaggttggaacaacaattctccggcaaggaaaccaaggaactgtggttatatgggcttgcgggaaacgatacgtttgaagtgaagggaaatacacggaaagattttccgatatacttgatctccggagagggggagaaccaataccaattgaatcataaccggaaaatacatgtctatgataaagattataaatatgattaccagaagataaaataccataagatatcttttaccccgtggggaatatatgattcggataaaggtattagtttgggtacgttctttacatatacgatgtatggctttaaacgagccccattcacctatcagcatcggatcgggtataattatttgaaagggttcatgtatgcaggtatcttccctaattatgacggccggagacgtttatacctaaatgcctccatttcttcaccccgtaacttcgagaacttcttcggatttggaaataatacggcgggctataaagaggagaaaaagaattataaccgggtgaagctccggacgtatatgtttaatccatccttcgagatggatttgaggaaagaagaggtgatgacattctttggctctttggatatgtacaaggctaaacgtacagatgatcgatatatttatacggtttatggagaagatcatcctattttccgcacgaattatttcgtaggtcttggtgctacttaccggataacgaaacagccttattcgtggcttcccctattggaaaccgaatggacggccggatggaaaatgaatttgaaaaagccggaacgcaatttcccctatgcgcagggaagcctttcatggaacgtacggttctcggatcgttttacttgggcctccttgatgaagggaacggtattattcgataatgactatgagttctatcaagccgccacgattgatttaaggggattccgtgagaaccgttttatcggaaagcaatccttttaccaatactcggatttacgcttggacatgggaaaactaaagaatccgttcactcccttaaaatatggtctattcgcgggctttgattatggtagggtctggtttcccggtgagcgttcccatagttggcatacttcctatggtggcgggatttggcttactttcttgaataagttcaccactaaatattcttggtttggctcgacggatagtttccggttcgcctttgagttggggcttgggttttgatatagcctcaaacctacacgggactgatgagggaaattctcatcatgataaggagggttattgtctatttctatatttgttcttgtcttctgtcgtatgacccggtaaaaacgtgtacgtgttttccgaaaaacatgtacgacttttgtgaaaaacatgtacgtgttttttcagaaatataatcatgtttttaaggatgatgataatcaatgatttacatattcgtgttatttgcatgcttattgtttggatttattatttgaatgtatcatctaattttttatcccttatagatatgttatagacaatacgctacaaccttatcaaatgaagttaacttcatcagcaaagtaacttaacatactttgctgatgaagctaaataacttatttcttcaaggcttccaatacttgaggcatcatagtacagatataatgttcttctttcgctgtaaagaaattgccatcgactacggaatcctcatctgtagcttgtcttttgctaatggcaggtttagccaacggatgtaccgctagcttctttccttccgtgattccggtgaagtcgaagagcatagcagcagcgcaatgtccaatcataatcttacccttttccccgaaattcttaatcacatccattagatcgatattgtattgtttgctagcgttctgctggaaaacaggaaccgcatcgccacaagcgaataccattgcgtcgtattcatcttcatgcccttttaaattagcgatcacatcgtctactgtcaaagctatgccagagttcgttttgatctcttttgaatcggctaccgcatatactttataagtaatgccattctcgaaaaatgattccaaatattggaacaaaccaaatccatttactggatttaccgctaaaactgctactttctttgccataatcgtaaattattaagtgatacaatagttatttttcgtaagtttattacttttgtgttgtaaaagtaagtcccttttttagagaaaacaagaaggcacttataaataaggaacttacatggatgtaaccattgttgagattcaagtaaatagaaaaggttaaaaaatgaaaaactttcatccgacagggaattgccccgtaagagacgtattgagccggctaggagataaatggtctatgttagtgcttatcactttaagcgccaatggtaccatgcgttttagtgatatccataaaaccatcgcggatgtatcgcaacgtatgctgaccgtaactttgcgcacgttggaatcggatggtctgatcgaacgaaaggtctatgcggaagttcctccccgagtagaatactgcttaacggaaagaggattaagtcttattccccatatccaaggattggtggattgggcgttgcagcagatgagtggtattatggaaagccgggttttacatacgtcatgacttgaaggtctaagaaaagggttaagcaaaggtggacttaataagattgacttttttctgcgagaatttccgctaaagatcggcgggttattttgttctcgatccaagatagaacatcgaaggtctttaggagttgacgctcgtatttgtcttcctttattttttgaatgtctttttgatattgttgccattgtttatttcgggctttctcataagaggggagcggataatctcgtacgaatttgaatattaatttctctgtaatataagtatgtttttcaaattggatgtttcttttgatagacgtgatctcattttcaaagaactcatagttccctaactctgcttgaaatagtaaatttattaatctagctatcttataagtaggaaatgtgtgaagtagttttcctaaactgaaaatctttttcatgtatttacgggtttgactataatcttttgtatacatacataaaatagcggaacttagatataaagataattgggtttcaagtcttaatgatgttattttttttagtaactcttcttcttgtctttcctttaactttttggcttgttcaaaatgtcccatatgtaataagctattagatttatagatatatactaatgtttttacatgtagtatgaactcagtggaatactcacctattgtcagagcttctagcttagaaaggaaaaatgaggtttcgcgatataggccagcgacatataaactgtctaaaacaccttgtatagcgctaaggtagtaaatagggggatttagtattaaatgttggttctcattgaataatccaatgagttcttgataatattgaatagctaatttataattccctacatttagataataagtggcttggaataacaaatgtaacttgttagcttcaaagcttcggcatgaactattggcaattagatatagttcactcaacacgagatcgttcaaatcttctttttgcttatcagaacggatatatcctttatggataagacgatgtttaagtatatcgtatagttgtgtgtgttggttaaggcttttggcatattttattacttcattgactttcatttgtttatttatcaactgtttttcagatattgtctcaaattctagggcacttaaatattttagctctattcgccgaattagtaaaagcaagggatcgttttcatacatacttgctaatttcttggatttatctaactcgatgaacgcttcatcatacatttcacgctcaaatagtatgtttgctttagatatgtagttgaaaattcttgcttgtatatcttgtttctctcggagtttaactaagcaatctaaaattgtgcgataaaggtgtttaactgcggtttcaaagttccttccattctggattttacaaaagcatgaatacaaatcttcaggagaggtattggagtctattaaattaaaaagtgatatatacactttatctccgctttgtaaatttgaataaagatgaaaataccttttttctgtttttgtcaaagaattgacaaggattataagtgtgtgtgtactgctcatatggctatagatggttttttaagtacttgataaatagtaatactaacgtaataaacaatgcaaatatatcaatttgggtttatctgtaatgccaattgattgataatttttttgttttttctctttttacatttgcaatatcaagagaggagctaatgtgaggatttgttaacattaaatcagtagcctatgggatacaggacgtttttttgataagagagtatgtaaactgtaaagaataaacctaatctaatccatattgttatgaatagagaaataaacactttaagcattaagggattacttgataaacgattttgggtaatcattgtttttttatgttgactttgcctgcctatgcggtaactaatgcgtttgtagtgacaggggaggttatagatgcagtgaataatcctttacccggggttaatgtcgtggagaaaggaacacgtaatggtacgatcacagatgtagatggtaaatttgaattaacgctgaaggatggcaacgctatactttcattttcatatataggttttacttctattgatgtacctgttgaaaataaacaaaatttgcgtgtaaaaatgagagaggacgttacccagatggatgaagttgttgttatcggttatggaacgactacaaaaaaagaggttacgggatcaatatctagtttgaaagaagaaagtttcgtgaaaggaaatatcagcaaccctatgcagttattacaaggacaggttgctggtatgaatattgtaaagcctaatggaggagatcctaatggagaattcaaggttcagttaaggggtatgacgacattgtccggtggcgcttctccattggtagtgatcgatggtattattgggggaagtttggagagcgtcaatcctgaagaaattgaatcgatagatgtattaaaagatggttctgccgcggccatctatggtactagaggtacgaatggagttattttgattatgactaaaagagcgagtggtggggaaaaaacaacaattgaattttctacttatgtagctatgcaatccgtagcgaaaaaattggatgtattaacagcggagcaatttagatctgtaatcaatgattattatccgaccatgaaagatcaatatgattttggggcctctacagattggtttgaggaagtgactcggaaaaatcctataagtcaatatcataatgtagcgttttcgggaggggcaaagtccttgggctatcgtgcttctctatcttatcaaaatgatcaaggacttttagataaaacgagcaataataagttgagggctaaaatgagtatcaatcaaagaaattttgatgatcgtttgtctatagattataatttgacatattcaaaagggaaaagcgaactagctgataattcgattttgcaacaagtggccagacgtaatccaacggagcctgtttatgatcaggaaggtattacaccaatatctggaggatattattataatccgggaccgtttcaatacttcaatcctgtagcgatggtaaatgaatctacaagagaaaaagaaatgcgggatgttatgggaagcatgaaagcttcatttgaaataattgagggattaaaagcgtctgtaatgggatcaatcactcaatcgtcttcaaataccggatcttattttggtcgttactatccgaaagattttgggacgaatggaagtgctgaaattaaaaaatcatcctcgaccaatagcctgttagaagctagtgttgattataggaaggcttttaaggatcatacaattcaagcgatagcggggtattcatataataaaggagaatatgaagagaactggtctcgtaactatctgtatgatacagactatttttcttaccataatattggggcgggagcagctcttacgcaaggaaaagcaggtatgagtagttacaaggatgaaaataagttgatcgctttttttggacgtgttatgtataattaccaagaacggtatttgctttccgcatcagtacgttatgaggggtcatcacgtttcggtgcaaataataaatggggaacattccctgctattagtgctggatggcgtattaataaagaacattttatggaggacataaaatggatcaatgatctaaaattacgtgtaggttatggtgttactggaaatcaagagataggaaattataaatcattgcaattattggaaaaagatagatttttttattataaggaaaattggattagtacgtataaacctgctagtaatcccaatcctgatttaaaatgggagcgtaaaggtgagcttaatataggcttggatttttcagtgctggaaggtcgtttaggaggtacagttgactactataatcgtacgacaaaagacttattgtattggtatacagtgcctgttcctcctaatttgtataatcagctttttacaaatgtaggtactataaagaattctggtattgaggtaacgattaatgctatacctgttcaaacaaaggattttcgttggaattcgatgcttacgttaagccataatacgaataagttggataagttctcaaataaagattatgcgatggtacaaatccggactggctatatcccagaagattttcagcaatatacacaaagtatcgtagaaggaggtccgattggaaatttttgggggccacgttttttgggtgtagacgaaaatggacagaatatattggaggatttgaataaggatggagtgataaatgaagaggattaccaagtaataggaaacgcatatccagatgtgacatttggtttctccaatacgtttacctataagaattgggagttaagttttttattgcgaggagcgataggaaatgatgttttgaatgttcatcgaatgtattatgagggttttaattactttggagggaagaatatcttggtatccacattggaacatcctgaatataagggatctgcagtgttttctgatcgttttgtagaagatggctcttatatgaaactagataaccttacaattggatataattttaggctgaatacttcatgggtctcaagattgaaattgtatctgaccgctcaaaatttatttacgattacaggttataaaggtattgatcctgaagttgatttatcgggcttagagccgggaatggatcggtatgagtattatccgagaactcggacattcttattgggattgaatattaacttttaaaaggattctatcatgaaaacattacataagattcatatattggcgattgctatttttagtattcttgcgcaatcttgtacgaatttagatgagaagatttattcgacaattcctgcggatgaattttttaagaatgaggatgaaatgataatgaatgtaggaagggcatatactcatttgacttcttatcttaatcactggaatatctggggtacattagtcattacatcagatgaaggtctgtgcccttaccgtgaaacaaatttatggtgggataatggggtatggatagatttgcaccgacataatttccattctcaatctggtaatttgaataattgttggagttttatttttgatggggtgactctctgtaatcagattctataccagatggaagaatcggaggttgattttccgacaaagaaaaatctggtggctgaggtgaaaatattgcgggcttggctttacttgaatgctatcgatatgtatggaaatgtccctttggcaattgatttcaaagaaaaagaattaccggatcaagtaggacggcctgctttgtttgaattcatagaatcagagattaaagggaatatcgatttgttggatgaggtcccggcggctaacaattatggacgtgtgacacaggctatggcttatacaatgttatcaaaactttatttaaacgcaaaagaatggattggaaaagagatgtggagagagacttctgatgcgtgcgataaagtaatagggtttggtaaattgtcgttagagcctaattacttttctaacttcaaggtgaataatgaagattctaaagaaaacatatttgtggtagctgttgataatatttatacaccctcggcgatgatttttcatcaaatgtgtttacatacgctgagccagcagacttttggtatcgtcgacttttgttgggatggattctgtgcgatggaaagtcattataaattatatacggatcaagatgtacgaaagaaatcttggttagaagggcctcaatttgattcatcaggaaatcctttaatgttaggacctaatcgtcagctaacttatcgtcctcaagtaaaggctttatataatgaatatgatcctgcattattagatgatggagttcgttttgcgaaatatgaatatgaatcaggcttaatgaatggaatgaacaatgattatgctttttatcgttatgcggatattttattgatgaaaggggaagctttagtccgtttaggtcgagcttcagaggctttatcatattttaatgaggtaagagcaagagctggggctccattatatcaagaaaaagatttaactttggaggaaatcttaaatgaacggagtagagagttagcatgggaaggttgtcgtcgtcaggatctgattcgttttggtaaatggaatgatgcatggtatgagaaagaggcgaagggtgattttacgaaactatttcctattccgtattgggcgattgatacgaatgtgaagttaaaacagaatcccggttattaattaaataattaagatatgagtgaaagaaacttgcggaaacataacatattggtagttggaagtagtaatactgatatggtaataaaaacaaaccatctcccccggccgggggagactgtgttaggtggaacattttttatgaatcccggggggaaaggtgcgaatcaagcagttgccattgcgagattgggaggagaagtttcatttatttgtaaaacaggtagtgacatatttggacatcagtctcagcaattatttgaagaagaaggcatagatacttcttatattttctcagattcaaagaatccttccggtgtagcgttgattacggtagatgcccatgctgagaattgtattgttgtggcttctggggcaaatgcgaatttactgccaacagatttagcgaaggcagaggaagctatagaacaagccgagttgatattaatgcagttagaaataccgatggatactgttgagtttgtcgcaaagacagcttggaagaaaaataagcgagtaatactaaatccggctccagctcaaccattgtcggctgcgttactccgccatctgtatatgattaccccgaatgagacagaggcggagatgatctccggcgtgaagatcacggatgaggtttccgcggagaaggctgcgcaagttataatggagatgggggtacagaacgtaatcattactttaggttcaaaaggagctttgatttactgtgattccatggtagatatggttcctgcgataaaagtggaagccgttgatactactgcggccggggatattttcaacggtgctttaacggttgctttggccgaggggcgggatttaagggaagccgtgagattcgcttgcaaagcttccgccatttccgtgactcgtgtgggagcgcaatcttccgctccttatcgaaatgaggtagatatctttgattaatctaaaaaacaatctaatattatgaaacaaacagtatttgcgatgatagcggctgcctctttatttataggggcgacctcatgttcccaacaaccctcggcaaaggatcaaacgacggttcccgctgagtttacgattagtaaagaaaagttgatggataagattaagggaggttgggccggacaaaccataggctgtacgtatggcggtccgacggagttcaaatataacggaacgatgattcaggaatacgtaccgatcgtatggccggacgggtatatcaaatggtggtacgagaatgttcccggattgtacgatgatgtttatatggaccttacgttcgtagatgtctttgaccggttgggattggatgctcctgtagactcattcgccatggcgttcgctacggcaggatatacgttgtggcatgctaaccagtcggcacgttataatattttacaagggatcatgcctccggcatccggtcattggctgaataacccgcatgcggatgatcttgattatcagatcgaggcggactatgccggactgatgtcgccgggtatgccgaatacggcttccgagatttctgataagatcgggcatatcatgaattatggagatggttggtacggtggtgtgtatgtcggggcgatgtattcgttatcgtttatctcggatgatatcgagtttatcgtgaccgaggcattgaagacgataccggagcaaagtatctattataaatgtatgagcgatgtgatccgctggcataaggaatatccggacgattggaaacgcacttggtttgaatgtgagaagaaatggagctcggatattggttgtccggatggtgtttttgttccgttcaatatcgatgccgtgatcaatagcgcatacattcttatcggcttgctttatggtgagggagatttctataaaacattggatatctctacccgttgcggacaagactcggattgcaacccagcctccgcgggtggtatcttaggaacaatccttggttatagccatataccggattattggatgaagaacttgagagaagtggagaatatggattttgcctatacgaccatctcattgaataagacttaccaaatgggcttcgatcaagcgttgcaagtgatagagcgcaacggcggttccgtttcaggtgacgaggtgacgatcaaatgccagcaacctgtagccgttcgttacgagaaggctttcgagggtatgtatccgatagagaaagtggcggttaataagaatttgcccgatgtaggagaactgccttttgagggaacaggcgccgtattcaaaggctttgtgaacgctaaagatgataaatacatagcgaaagtagagatgtacctagatggggagctggttgagacggcgaaccttccggcatcctatacgactcgtaggaacgacctgttctggaagtatcagctgcccaagggaaaacatacggctacgtttaaatggctaaatccacgtaatgatgtctccgttcatttcagcgagatactgatttactcggatgctccgaaagaaattgttcaccaataaattataaagattatgaagaaatcattgtttctgatgggtttatttgccttgttgatttcctgtaagggaaatgtgtcgaaaaatattcctcaaaccgataagcctcaaccggtaaatcttattctagataccgatttaggtccggactatgatgatgtgggcgctatggccttgatgcatgccttggcggatagcggtcaggtaaatatccttgcgactctttcctccaaccatgatgagcgggtggtaccttgcattgaggtgttgaatacttatttcaaccgtccggacataccggtaggggcaccaaagagcgaaccgggggcctccttgactacttggcataaaacgaagtggactgacgagttacccgctaactatccgcatcatacggcgaagacttccgacgctccggatgctctgaaggtgtaccgtaagattctgagcgaacaaccggataccagcgttgttatttgtacgattggtttcttctctaatttaagggacttgcttcaatcgggagctgatgaatatagcgatctctccggaaaggaattagtcgccaagaaagtgaaacgtttggtttctatggcgggcctgtttccggaaggtaaagaattcaatgtgtattgcgatgtccctgcctcgaaagtcgtagcggaggaatggcctacagagattgtctttagcggttttgagatcgggaacgtaatcttgactggaaagaaactggtgcaaatgaacgtggagaacagtcctgtaaaagatgcgtatgccctttgtttcgcggagggagacccggaagggcgcatgagctgggatcatacggcggtattggtcgctataaaaggttatgagccttatttcgatgtagagcgaggtacctttcatgtcgtagatgatgaggggactaacaattgggtggcaaatcccaatggccgtgatcttcgtttgatcgagaagatgccgcctacggaggtcgcttccttgatagagaattatatgatgcatcaaccatctattaaatagtattttatgtatatcgtacaagattattctttagctgtcatattctgtgtcgttacgatgctttgttggggatcgtgggggaatacgcagaaattagcctccaagacttggagatatgagttcttctattgggactacgtgattggtgtcttgctcttttctctgatttccggctttaccttgggcagcatcgggacggaaggacgcagtttcctgccggatttggcgcaagcgaatctcgctagtttagggagtgcctttttgggcggtattatttttaatgctgccaatatcttgttgtctgcggcgatcgccatttgcggattgtcggtcgcttttccggtagggatcggattggccttggtgctaggcgtattggttaactatttcggggcggcgaagggggaaccgacttatatctttatcggtgtagccttaatcacgatcgccatcatcttgaacggcctggcttataagaaagccttggtcggtaccaagaaagtatcggggaaggggatccttatatcggttgtggccggcgtgatcatggcctttttctatcgttttgtcgccgcttccatggatatggagaatttcgcttctccggcacccgggaagttgacgccttataccgccgtatttgtttttgccataggagtatttgttagtaatttcttatttaacacattggcaatgaaacatccggtggaaggtaagcctgtctccatatccggttattttaagggagatatgagtacgcatctcgtgggtgtattggggggtgttatctggtgtatcggtcaatctttcagtatgatagcgtcagagaaagcgggagcggctatatcttacggattggggcaaggagccacgctagtctccgctttatggggcatccttatctggaaagagttcaagggagcgccagccatttccaatcgtctgaatgtcgggatgtttattttattcgtgatcggacttgggttcttaatttatgcgggagcttaaataacgttatttttatttattccggaaaaaacattacctttgttcttgtttcttgtttatgggagtttaataacgaaaaaagacgatctatgaaagaagaaggtgatgtattcaaaaagttccgtgattccttcagcaggatggagggacatttccatatactagaacagcgtgtgccggttgaacttcagatggagtatttcaaatactcggaaaacgtacggaaggaaaaccggcctccccgtcccttatcggaggatgagtgcgagaccctgtacaacactttgttgacggaggaaaccacggacaagaccgagaagagatatttgttatctcaattggctacctcgaaatccgtccgtgcgtaccgcttgttggaggaatacacccagcatccggacccggaagtgacagattgggcctacatggctttgatggagtctcgtatctctttagagtccgatttctccgacgagaaacaaatttatatctcgaccggcttgggaggaaaaggggagaagctgcgtttctatgtcttgatgacgtctaaaggcaagaaacctttccaagaatatcagcggcagacaatcgagcgggagttcgcttattatctgccgaaaacggactgcgagatcgagcgtttgacgatcggtgagcagtatgtggagctggtgttcttgatcccggtgcgtacggatataaaagccacgttggaccgggtgatcaatgaatgtaaccaatacggcgatttcctctcgaatgttttcacgatcacgaatgtcaaggaattgacacccgaggagatttccgagattataagtaagaatggagacgattaagcaagctattaagtatggtgtagtcgggttgagcaataccttgataacgatgatcgttatctgggtgatgatgaaactcttcggatgccgggaaggtttatctaacttaacgggatatgtggcaggcatattaaacagtttcatctggaacaagcaatggactttcaagggaagttccaccggatggacgaaaggggcggttcggttcacgatcgctttcattatttgttatgccttacagtacggattggtactgatcttgaattcccgacttacgatcgatcattactacaaccacttgattggaatggctttctatacggtgattaattttttagtaaataagttttatacctttaaagcttaaaaggcatgaagaagttagcggttatagtcccgtgttataacgaggaagccgtgatcgaggaatcgtatcggcgtacgaaagaggtcttggtaaagttgccgaaccctacggagattatctatataaatgatggcagtcaggataagacacgttctttgttggatcatatagccgctaccgatcctcatgtgaaggtgattcacttctcccggaatttcggtcatcaaccggcggtaacggcgggtatcaataactgtgacgctgatttggcgattatcatcgacgccgatatgcaggatccgccggaattgattccggatctgctggaagtgcaggagagagaggatgccaacgtggtttattgcgtccgtaagtcacgggaaggggagagtcttttcaagctgttcacctccaaggctttttaccgggtgatgaattatatgagcgaggtccatttcccgctggatacaggagatttccgtttagtggaccggaaggtgatgaatgagttcgaccgttttaaggaacggggaaaatatatccgtggcttgataagctgggtgggcttccaccaagtgccgttttattatgagcgtgaggcgcgtatcgccggcgagacgaaatatccgattagtaagatgctgaaattcgcgtcgacggcaatgctttatttctcgaagaagccgttgcgtttggcgacgagtctcgggtttatatccgtattggtcggtataatcttggcggtttggttcacgttgggcaagatctatggttttagtaacgccgaggttggctggacttctatcatgacttccattatcttctttggaggtgtgcagctattgacggtcggcgtgttagggcaatatgtcggtatcctctttgacgagatcaaggcccgtcccgaatacattattgacgagaagaaaaactattaaaaaacatcggaggcgaaataagccgtttttctatgatctgaattctgttccatgataaatgtcttttcatgatatacttgtgaatgtaacataaacaattcgatatccggatagtttatacatagaagagattaataaaacttatgtgtcatgaagtatagaatagagaaagataccttaggtgaggtggaagtgccggtggacgtttattatgggccgcaaacacaacggagcgtgaataatttcaagatcgccaccgatattagccggatgcccaaagaggtgatagaggcgttcgcttacttgaaaaaaggagcggctttggctaataaagacgccggcgtcttgtctccggagaaatgcgagttgatcggtaaggtatgcgacgagatcttggcgggtaaattaaatgactccttccccttgatcgtatggcaaacggggagcgggacccagacgaatatgaatgtcaatgaggtgatcgccaaccgggcgcatgtgctgaccggaggaaagctaacggataaggagaaagtgctgcttccgaacgatgacgtgaataaatcgcaatcctccaatgatacgtttccttccgctatgcatattgccgcctataaggtgactgcggaggtgacgatcccgggattggagagtctgtatcgtgcgttggcgctaaaaagtgaggagttcatgaagatcgtgaagatcgggaggactcattttatggatgccactccattgacattggggcaagagttcagtggctatgcggctcaattggaatatggtatacggaaagtaaaggattccctgtcgcatatctccgagttggctttaggaggtacggcggttgggaccggtattaacgccccggtcaattatgacgagtgtgtcgctaagaagatatcagagttgactgggcttccttttgtaaccgctccgaacaaattcgaggccctagctacccatgatgccttggttgaggcgcatggagccttgaaatccgtagcggtcagcttaatgaagatcgcgaacgatatacgaatgttgggctcaggtcctcgtgccggtatcggtgagatccatttgccggagaacgagccgggttcctccatcatgccgggaaaggtgaatcctacgcaatgcgagtcattgacgatgctcgccgctcaagtaatgggtaacgacgtgacaatctcgatagccggctccaacgggcagttcgagttgaacgtatttaagccggtgattatctcgaacttcttgcaaagcgcccgcttgattggtgacggttgcctgaatttcagtgaacgttgcgtaaaaggcattaccccggtgaacgaaaacatcaaacgccatctggatagctccttaatgctggttaccgccttgaatccgaaaataggatattacaaggccgccgctatcgcccagaaagcctatcaagaaaataagactttgcgggaggcggctatcgagtccggttatgtgaccgccgaggagtttgatcgttgggtagacccgtccaagatggtaggaaagattgagtagtgtcaaaactgctacatcttctcccaaaaatgaaacaaagagttaagatgataatggatatttttgtaccgttatcattttaattctttgtattatgaagagcacacgatgtattttgtctataatcttagggttgctggccggatggctacctctgggtgcggttaccgtattgaagaacctacaggttgagtatcaaaccaatccactgggaattgatgtcagtcagccacgttttaactggcagatggagtccgatcgctatggggcctgtggacaggcttatcggttatgggtggccgatagtccggagcaattggctgccgggcgttatatctatgattcgggaaaggttctttccggggaatcggtcggcgtagtttatcaaggaaaagcattgcaaccttccactcgctattattggaaagtttccgtatgggatgaatcgggaacggaaattacctccaccgagcctgcgtggttcgagaccggtcttctgggttccggatggagtggtgcccgttggatcggctcgtcggagacacaactctccaaatatcgctcgcattatgtgatcgactatgatgtgcgggttgccgagggtaatgataaagccgtatttgtctttgggtcgagggacgctgataattatgtgtctgctgaactggacttgaatggttcgggggacgcccgtttcattttacgtcataccacagatggaaaaacgaggcaagatgcggcggaaagtctggcttctatcatcccagcctcggataagcataaggtgcatcatatccggttgaaggtgacgacggcccaatatgccttgaaatatttcgtggatatagagatcgatggaaagaccttggtgaattcctctttgactcccgaggagaaagaacggaagagccgtggtgatttctggggaggcaaggaaggggctttcaccgtgtatccttatccggatggagagttggtttatcattgccgcttgtacgcgatcggtttcctgcaacctaaagggcagaccgctacattctccaacttgcgtatcagcgaggatacgtggaatacgcttctgtacaatcctgccgagacttatgtggagaaaggggagggaaagctcaatgtctggtatccgggtgagaacgtatccgctcccatgctccggaaagagataaagatagagaaaccggtcaagagcgcccgtttatatgctaccgctaggggtgtctacgagttctcggtgaacgggcggaaggttggaaaggattatctgaatccgggttggacggattaccgttaccgtatcatgtataatacgtatgatataacgagtttgctacgaccgggcgataatggtatcggagcgatgttgggcgccggatggtggagcgagcatagcggtttccttaccggttggcaggatcaatacggaacccgccagtccttattgggaaagatcgtgatcgagtatgccgacggtactcgtgagacgatcgttacgaatgatagctggaaatgttatgaccggggaccgatcacttttaacggccttcagaatggagaggaatacgatgcccggaaagaggtgaacggctgggatgctccgggttttgatgactcgtcatggaaaccggcgaccttatttgccgctcctccggtaaatgtggagatccaaggatatgtaggcagcccgatacaaaataatgtgaccctgaccgctcagtccgtggtagagcctattcccggcgtctatgtctatgatatggggcagaatatggtcggtgttccccgtctgactttcaagggaaaggccggacaggaaatcacgatccgtttcggggagatgaattatccggaaacgatccctaccgaacctgtcgccccgtacacgatcgcgatgtataaggagaagaaagggcaagtctatacggataattaccggagcgccctttccacggatcgctatatcctgagaggggatgcggcgggtgagacgtatgagcctcgctttacgttccatggtttccgttacgtggagattcacgggttggagaggccgttacccttggaggcggtgaaagggatcgtgctggaatctatcggtgcgcggacgagcggttatgagacatcggacgagcgtgtcaaccgtttgttcagcaatatcatctggggccaacggggtaatttcctgtcggttccgaccgattgcccgcaacgggatgagcgtatgggctggacaggggatgcgcaggtatttgcccgtacggctacttataatatgaatgtcgatccgttttacacccgttggctctactcggtccgggataatcaaggagatgacggtagttacgcgaactatatacccgtagtcggtttccctccacacggcgcggaggatggcggaggtgccatgggatggatggaagccggcgtgatcgtaccgtggcaaatgtatcaacaatacggagacgtgcgtattctggaacagcattacgcttccatggtcgcttatatggattatttggagcgtcgtgccgtacgctatgtacagcccttcggtggtttcggcgattggctggctatcgagccgacgaattccatgttgacgaacaccgcttactccgcctacgacgctttgattatggagcaggtagcgaaacgtttagggaaggacgcggaccaaaggcgtttccgtactttctacgagaacgtgaagaggtcttttaacgacctgtttgtaaacgaggaaggacgcacgttcgccccgacggtggaatctatctttggtaaggactcgcaagtaggtatgtggtccggaacggcggctaccgaggcgaaaatcgtagatacgcagacctcatacgtggttcctctccagtttgatctgttcaatgagaaaaacaaacccttggcgatccggcatctggtagagaatatcaagaaacataattatacgcttaccactggctttatcggtacgccttacctgaatttggtattatccgacaatggttatgacgatgtcgcctataagctgtttgagcaaaccgcctatccttcatggctgtatcctgtcctgcaaggcgctaccacgatttgggaacgttggaattcctacacgttggtaaatggcttcgcccctgtggatatgaactctttcaaccattattcgtatggcgctatcgaggagtggatgatagcttataccttgggtatccagcgggatgaggaacaacccgcctataagcacatcatccttcaaccccgtatcggcggaaccttctcgttcatccggggtcattacgattccgcctatggccgtatcgagagtggatggcaaatccaaaagaagggctatatatacgaggcgaccattcccgctaatacgacggctaccttatatctgcccgccaaatcggagaagtccgttcgtatggagaaagggcaggaggggatcacgcccgtgggattgaaggatgggaaggctgtgtaccgattgggatcggggagctaccggatatacgtggattgaatatttcccaaatatcccgcccgcgtcgggtgcgcggtcgaatcttggagaaatgcgggacctcgcgccgggtgcgcggtcgaatcttggaaaaatacggggctcgcgtcgggtgtgcggtcgaatcttggagaaatattggacctcgcgccgggtgcgtggtcgaatcttggagaaatacggggcttacatcgggtgcgcggtcgaatcttggagaaatgcgacgcttctcacccggtgtaaggtcagattttgtaaaaacgatagtgcccggccttattaaaatctgtacattcgcgcaaaaataaataagaacattgttcatgattgtttaattctaattagatcaagcgagaatgtcaatacgaaaatcggatcgcattatcagcgtggagcacgtatcgaagtatttcggcgagaaggccgtgctgaatgatgtaaatttacaggtccgcaagggcgagtttgtaaccattttggggccttccggttgcggaaagactaccctgttgcgtttgatagccggcttccagacggcctccgagggcgttatcacgatgtccgggaaggagattacgcagacgccgccgcataaacgtcccgtaaatacggtattccagaaatatgctttatttccacatctgaatgtgtacaataatatcgcctttggcctgaagctgaagaaacttccttccgccacgatcgagaagaaagtgaaacaggcgttgaaaatggtagggttgacagactatgaggatcgggatgtcgattccctttccggtggccagcagcaacgggtggcgatcgctcgcgctatcgtgaatgagccggaggtgttattgctggatgagccgttggcggccttggacttgaagatgcgcaaggatatgcaaatggaattgaaagagatgcataagtccttaggcattacgttcgtgtacgtgacccacgaccaagaggaagcgctgacgctgagcgacacgatcgttgtcatgagcgagggaaagatccagcaaatcggtaccccgatcgatatttataacgagccggtcaattcgttcgtcgctgatttcatcggtgagagtaacatcttgaacgggacgatgatcaaggataggcaagtctctttcgccggtcatgagttcgagtgcgtggatgagggattcggggagcaaatgccggtagatgtcgtgttgcgccctgaggatatttacatcttcgagccgtcggaggcggcgatgctgacgggtacggtaacctcctccatctttaagggcgtgcattatgagatgatggtgcaaaccccgaacggatacgagttcatggtacaggattaccacccgttcgaggcgggtagcgaggtcgggcttcttatcaagcctttcgatatccatgtaatgaagaaagagcgtatttgcaataccttcgagggaaagctcatcgacgctacgcatgtggaattcctaggctgtacgttcgaatgcaaggaggtaaccgatatagagccaaatacgcctgtgaaagtcgagatcgattttaaagatgtgatcttggaggataacgaggaagacggtcgcctgaccggagaggtgaaatttatcctctacaaaggcaaccattatcatctgaccgtgtttacggattgggacgaggacatctttgtcgataccaacgatgtatgggatgatggagatcatgtcggcataacgatcgccccggataaaattcgaattattcatgcttaaaaagggaaggaagtgatcaatacgttttctgcattttttatgagacgaaggaactggaccattccttatgtcctgttcttggccatctttgtcgtgataccgctcctcttgatcgtgtattacgcctttacgaatgacgaagggatgtttaccttcgccaatttccgtaagtttatgatccatcccgaggcgataaacaccttcgtgtattcagtcgggatcgctttgataacgaccattctttgtctgctgctgggatatccggccgcttggatattgagccaagcccgatttaatacttcccgtacgatggtcgttttgtttatccttccgatgtgggtcaatatcttgatccgtacgttggctaccgtggctttgttcgatttcttgaatttcccgctgggagagggggccttgatctttggtatggtgtacaacttcctgccctttatgatctacccgatttataatacgctccagaaaatggatcacagcttgatagaggcggcgcaagacttgggggcgaatccgtcgcaggtatttatcaaggccgtattcccactatcgatgccgggagtgatgagcggtatcatgatggtgtttatgccgaccatctctacgtttgccatcgccgagttgttgacgatgaacaatatcaagctcttcggtacgaccatacaggagaatatcaataacggtatgtggaactacggggcggcgctttctcttatcatgttgttattaatcggaatcacgggattgttcagcaatgagagcagtgattcggcgaatgagggagggcttatctgatggtgaaatatttagctaagggatatctatgggctttgttattattgctctactcgccgatcttgattatcatgatcttctcatttacggaggcgaaagtactgggtaactggaccgggttctccacgaaattatatagctctctttttgccggcaacgtacaacattcgttggtcagcgcactttggaatacgttcgctatcgccatgatagccgctacggtatctaccttgttggggagcgtagccgctatcgggatctttaatttgaaggcaagggcccgcaatgccgtgagttttgtcaataacatcccgatgttgaatccggatatcattaccggtatttccttgttcctgttgtttgtcagcttagggatctctcaaggtttgacgacggtcgtgctggcgcatatcacgttctgtacgccgtatgtggtattaagcgtcatgccccgcttgaaacaaatgaaccagaatatctacgaggcggcgttggatttgggggcgactccgtttcaggccttgcggaaggtgatcttcccggaaatccgtccgggtatgatcagtggctttatccttgccttcacgctatctatcgacgatttcgccgtgaccatatttacaattggtaatgagggcttggaaaccctttccacctttatctacgcggatgcccggaaaggaggtttgaccccggaactgcgtcccctctcaacgattatattcgtaaccgtgttagtattgttgattgttataaataaacgtgctgagaaagcgaagcgagcgtaaatgaaaatgaagaaatttatatcgattctgtctgttttggccctgcttatggggctgttcacttcttgcgggcgctcggacgaggagagaagcaagatcttgaagatttataactggggagattatatcgacgaggacgtcctgacggatttcccgaaatggtataaggaacagacgggtgaggaagtccggattatctatcaggtctttgatatcaacgagatcatgttgaccaagatcgagcggggacatgaggatttcgacttgatttgcccttcggagtatatccttgagcgcatgctgcggaaaaatctcttgctaccgatcgaccgtaatttcgggaagacaccggattatatcgacaatgtctctccctatatccaagaggaactgaataagttaagtcagccgggccgtaagactaccgactacgtggttccttatatgtggggaaccgccggcctgttgtataataaagccgatgtatcgagggacgaggtaatgtcgtggaaatgcctttgggaccctcgtttcaggaataagatcttgatgaaggatagttatcgtgacgcttatggaaccgctatcatatacgcccatgcgagggaattggcgaatggtacgatcacggtggagcaattgatgaacgatagctccccggaaatgatcgctatcgccgaggaatacttgaagaagatgaaaccgaatatcgccggttgggaggccgatttcggtaaggagatgatgacgaaaggaaaggcgtggctgaatttcacttggagcggcgacgcggtctgggccatggaagaggcgagtgccgtaggcgtagatctggggtatgaggttcctttggagggtagtaatatctggtacgatggttgggcgatccctaaatacgctcgcaacgtgaaggccgccagttattttatggactatctatgccgtccggacatcgtcagccgtaatatggaagtgaccggatatgtcagcaccgtggctaccccggaaatattggcggaaaagatcgatacgacgctgaccgagttctcggacgtaagttatttcttcggaccgggagcggagcgtatccggatagacccggctcaatatccggaccggaaggtcgtggaacgttgtgccatgatccgtgatttcgggaacgagacggaggtggttctggaaatgtggagccgggtaaaaggtgacaatcttaactcttggattgttatattgatattcgctgttttcggcttgttgtttgtctgggtcgtttacaagcggatcaatcgttatcaacagaaaagacgacatcgtagacgtcgtagctggtataaaaagaaatgatatggaaggcataaagaacttgattatagacttgggcggtgtgcttattaacctgactcgcaaccgttgtatcgaggctttcgagaatctgggcgtggagaatatccgggaacagatcacgaataactatcaacataaggacttgtttgagcgattagagttgggaacgatttcggtggaacagtttcgcaatgatattcgtgccttatcgggaaagcccctgacggacgaacaaatcgacacggcatggatcgccatgttgggagacgtcccggaaaataagttgcgtttgctattggagcttcgtgaacgctataatacgatgcttctgagcaatacgaacgagcttcattggaaatggtccgaagatacctatttctcttatcaaggtctttgtgcccaagatttcttccataagatttacctctcttacgaattgcatatgctgaagccgaacgcggatatttttgagtacgtactgaaggactcgaatcttttagccgaggagactatgctgattgatgacgcttccgtgaattgccgggcggctgaattattgggaatgaagtcctatatgccgcagcaaagggaggattggtcgcatctattcaaatgaaggccggtcattgtttggtcccggcctaaatgtctttaacctttaggatattatacgaggtaccaagatcatacacatcattcccgtctactttcttgatgtactttacgacacggatggtgacgggaaggatgataacctcgtacaaggatttaagtaccgcctgcgtcccgatcatgataagcaattctccggccgggatcaatccggcgaaggcgatcgggaaaaagatcagggaatcggcgctctcaccgataagggtagatacgatcgctcgtaacgagaaattctttccgttggaggcgattttcattttgctcatcacataggcgttcaggaaagaaccggccaaaaacgctatcaagctggcgaccgctatacgtggggccatcccgaagacgaaattgaaaccttcctccccctcccaaaaaggggcggccggtaataataccgccaattgcgcgaatgcgatcaccagaaaattagaggcgaagccactccagataattagccgtgccttcttgaatccccacacttccgctatacaatcattgatgatatacgagatcgggaatacgatcaaacctgcggtagccgttataccgcctacttgcactacttttgtctctaaaagattggacgctacaaggcatatattaaaaagtatacctagcagcatgaaaggtactgtaactgttttttgcatgtcttcttgtttttaacgaggtttatcaagcactcgggacgcgaaggtacgaaaattcttattaaaaacgatgggtatagcagataccgatcgcatggcggtaattcacgggatcgtctacattaaatatatggtagcgataatagagttggaggttattgttcgggtttagttggtaattacttcctgtggagaaacggatcttatcggaccgcatcttatttcgcgtatcattgaagacctcggtgtaggcaaaaggacagaaaccactcttgccgatcttataggagagggtcagcatcgaacgcagataattcttgggatgttcggcgtgaaccttataggtactttgaaaacgttcccggacagagagggtaaaacgtccggccgaataagtccccgtagcgtagagataatatcggtttcgtaactcgtcggatgccttgtatcgtgctagagacatatatccgcttcctgccagaagatatttattaaacttgtagtttacctcaacggtggtgaggaaccattccgcttccttaaagtcatctctcggacggatgtcctcttctacaagaaaggataaatgcttatagatttttccgcataggctcgccttgaaatatacacctgcgccttccattccgtatagggatgaagtgcatcctattataaagaataggatcagataaatagatcgttttgtatatgatgtgtttttcatgtagagtgacttccgatgcaaaagtagtgtttttggatgtaataccaacgcctcaggatattatatccgatttttcttatatttgtctcctattaactatcaaattcgaatacatggaaaacatatcaagaagaacggctatcaagacatttttagctggaggcgtggctttggcgactacaggtatcgaggcggcagccgccgcgaaaaagaaaacagacgtgaaggaaaccttgaaaggaaatgtccgccattccgtaagtaaatggtgtttcggcgattataagctggacgagttctgtgagatctgcaagcatatagggattgaatccgttgagttgctggacccggtagattggccgatcgtacaaaaacatggcttgacggtggcgatggcgcaaggggccgggcttggaatagatcgaggtttcaatgatccggccttgcatgacgagttggtcgccagttatgagaaggtgatcccgatggtggcggacgctggattgacaaacttgatttgcttctccggcagacgtaatggcgtaacggacttgcaaggctgggagaactgcgagaaggggttgaagcgccttatcccgttagcggagaaacataaggtcgtcttgaccatggagcttttgaacagtgtcggccataaggattatctgtgcgatcatacggtttggggggcggagctttgtcgccgtatcggttcccctaattttaagttactatatgatatttatcatatgcagatcatggaggggaatatcatcgagaatatccggaaatataatcaatacttctcccatgtccataccggaggtagcccgggacgtgcggaaatcgacgagacgcaggaactttattatccggctatcatcaaggctcttatggagacaggctataaaggcttcgttgggcaggagttcgtccccgcccaagaagacaagatcgcttccttggagaagtgtatccgtatctgtgatgtatagggctatttagtaataacttacagtgccaagccagtgccgttatagtggcacggctgtgccaccagcgtggcatcgttgtgccatcgctatggcatcatcgtgccataagggtggcacgactataatactagaatgacaaagaccttgaatttattttctccagccatgttacgttttcttttctcgattgtcattaagatagaatggaacaagaacagtttaaaaaagagatattgcctttgcgggagaaactattcctttacgcgagaaggctgctagataacccggaggatgccgaggatatcatgcaggaagtctttttgaaactgtggtatatgcgtggcgagttagactattataataatgtaatggccttgtccgtacaaatcacaaagcacctttgcctgaatcggatgaaagttcgtgaacgcacggaaggtgaggcgggcgaacaattctttatctgcgatgcctccacgccttatacccagctggaacaaaaagacagtttggagcatgtaatgcggcttatcaataaactaccgggacttcaacagaccattcttcgcatgaaacacgtggatggtttcgaggtagaggaaatcgccgggttgaccggaagtacccccgaggcggtacgtatgaatctttcccgtgcccgtaaacgggtgagagagcaattctttaaaatgcagacgttatgaaaacagaggaatacaagtctatagaggatttattagaccgcttcttcgagggccagacctcgaacgaggaggagcgagtgttgtataagttcttcgcccgtccggatattcccgcccatctggaacgttatcgggaggtattcggatacttcgagagtggcattgccttggattttagcgagactccggaattgaggctacccgttaaggaatcttctgataagcgaaaaatgggatgggcgatcgcagtttgcgtggcggcttctcttttgttgtttttggtgaatacggtctttatgaatcaaaatgcttcttttaacccttatgagggaagctacatcgtgcgcaatggtgtcgtaatgacagatataaagaagatacaacccgaattggaggtcatatcccgagcggcggaagcgatggagaagaatgcggatcggctcttaagaaatgcggatgaaatagcttatttgccggaaaggatgaataagcggtttgagaagaaacgggagactctactgaggaatattccggatactcaggtacgtaaggaagtttataagatcttggaattggataaatagtaaattaactaataaacaaaagaagttatgaaagcaagtaaatgtttttgggtggcattatgccttttggtgggaagtttcagtacagagttatgggcacagaagaatttggaggctgtcgtgcagaaatgtaaagcggataagacgatcgataaaagcgtagtaacgaataaagatccgaaaactaaaaaggtatataagatagtctcttctttcgtcgtggagggccacgccgcattacaacaagaaattaaatccgcttttgagcgggataaggaagaggcttatcaagtgatcgagaatgagaacgatggggtggttagttggtttatccgtttttcgaagggtaaaaatacagtttcttattctataaatgttgatgaggaggagcttctcttgacagtcattgagaacttcgacatgccggaggaaaaagatatagagataagatcaagtagtgacatgtaggttttactatgtagataagtcaacaatagcacctctcatctgtgaagctgggaggtgtttttttatgtcgagatattggatagtagtgtctaaattttgtacaccactgtcaaataattggacagtctgttttggaaagtaaaatactacttgtttgagaattaaatatttagttagtttggcacactatttgaattagatatggtaaattaaatagttagataacaattaaaacaaatacagtcatgattaagatcgaaggtttaagtaagtttttccgtacggaagaggttgagacattgtccaccatccgttgcatgatcatgcaacggatggtggacaatcatgcaacagatggtggataatgaatgtctcaggaagaaaggcgtaataggacaagggaagatcctttaaaagtatcgtgataaggaagaatatttgcccagtgtgtttatgcttcccgaatttattactacctttgcgccactcaattaaataatcataattgcatgcacgagaaacttattattcttgatttcggctcgcaaacaacccagcttatcggccgtagggtcagagagttgaatatgtattgtgagatcgttccttataacaaattcccgcatgacgctaccgacgtgaaaggtgtgatcctttccggaagtccttattccgtatacgacgagaatgcctttaaggctgatttgaccgagatacgggggaagtatcccgtcttaggtatttgttatggagcgcagtttctagcttatacatccggaggtaatgtggaaccggctaattcacgtgagtatggacgtgctaatttgtcgcacattgatggtgaggatgaattactgaaagggatccatgtgggttcacagatatggatgtctcatggggatacgattaccgtattgccggataatttcaaggtgatcgccagcacggacgacgtgagggctgccgcttaccatgtggaaggtgagaaaacgtggggcgttcagtttcatccggaagtattccattcgacagacggtacgaagttgctggataacttcttgaatatttgcggatgcgccaaggattggacaccggcttcctttatcgaatctaccgtagctgagttgaaggagcaattgggagatgataaagtgatcttggctctttccggcggtgtggattcatctgttacggccgtattgctgaataaggcgatcggtaagaacttgacttgcattttcgtggatcatggtttgctgcgcaagaatgagttcgagaacgtaatgagggattatgagcatttaggattgaacgtgatcggcgtaaatgcaaaagataagttctataaagaactagcgggcgttacggaaccggagaagaaacgtaagatcatcggcaaaggatttatcgatgtcttcgatgaggaggcgcataagctgaaagatatcaagtggctggggcaaggtacgatttatccggatgtgatcgagtcgctgtctatcacaggtacggttatcaagagccatcataatgtgggcggacttccggatacgatgaacttgaaactcgtcgagccgcttcgtcttcttttcaaggatgaggttcgccgtgtcggtatggagttgggtatgcaaccgcatttgatcaagcgccatccgttcccgggaccgggattgggtatccgtatcttgggtgatatcacgccggaaaaggtacgtatcctgcaagacgctgacgatatctatatgtcattgatgcgtgagtggggactttacgataagatttggcaagctggggtaatcttacttccgattcaatccgtaggtgtaatgggcgatgagcgtacctatgagaatacggtagctttacgtgcggtaacttccacggacgctatgaccgccgattgggcgcagcttccgtacgagttcctcgccaaagtttccaacgagattatcaataaggtgaaaggcgtaaatagagtcgtgtacgacatcagctcgaagccgcctgcaaccatcgagtgggagtgacatttgtcttaggtataacaaagtgtaaaatcaataaaatttaaaagtcacatgaagcaagatatgattgttatcttggatttaggtagtcatgagaatacggtgttggctcgtgctattcgtgcgttaggcgtttatagtgagatttatccgcatgacatcacggttgaggaattaaaagccttgccaaacgtgaaaggtatcattatcaatggtggtccaaacaatgttatcgacggtgtagctatcgacgtgaatccgggtatttacgagatgggcactcctgtaatggccgcaggtcacgataaggcgttgtgcgaggttaaattgccggagtttacggatgatgtcgaggcgatcaagggcgctgtcaagtctttcgtgttcgatacttgcaaggctgaggcaaactggaatatgacgaattttgtcaatgaccagattgagttggtgaagcgtcaggtaggggataagaaagttctgctggccttgtctggaggtgtcgatagctctgtagtagccgctttacttttgaaagcgatcggtgataaattggtttgcgtgcatgtgaaccatggtttgatgcgtaagggcgagtccgaggatgtcgttgaggtcttcaagaaccagttgaatgccaatttggtgtatgtagacgctaccgatcgtttcttgaacaagctggccgacgtggaagatccggagcaaaagcgtaagattattggtggtgagtttatccgtgtatttgaggaagaagctcgcaaattagatggaatcgatttcttggctcaaggaacgatctatccggatatcgtggagagtggaacgaagacggctaagatggtgaaatcccatcataacgtaggcggtctgccggaagatttgcaatttgagttggttgagcctttgcgtcaattattcaaggacgaggttcgtgcttgtggcgtagagttaggtttgccttatgacatggtttatcgccagccgttccccggaccgggtttgggcgtacgttgcttgggcgctatcactcgtgatagactggaagcggtacgtgagtcggatgcgatcttacgggaggagttcaagaacgccggactggataaaaaggtatggcaatactttacggtagtacccgactttaagtcggttggcgtacgtgataacgcccgttctttcgaatggcccgtgattatccgtgccgtcaatacggtagatgccatgaccgctacgatcgaaccggttgattggccaatcttgatgaagattacggatcgtatcttgaaagaggtgaagaacgtgaaccgtgtatgctacgatatgtctccgaaaccgaatgcgacaattgagtgggagtaattaggcttactttttaaacagatataaaaaggcccggtgatttatcagaatcccgggctttttatttatatacgatagattcgaagaactattttagttcacggatcttgatattacggaaccatataggatagccatgatcttgcagacctatataaccttctttagagataccttcggtaaaacccgggaagttcttgaatttactgttagctaccagatcatcccactctttgctccataaagtgtactcaactacttttttgccattttgagtatgcgttacttttccatcttttacacggattacgatcgtattccactcgccggcaggattaactgttttcggatctgcgggaagcatgtcatatagagaacctgctaggtggttcgctaatttgttgtcggttgcgtccacgttatctagtacctgtacttcgggagccgcataataaataggtttgccgggtacttcgcgtacataatagaagataccggagttgcccatcttgctggctttccagtctaccgaaagctcgaagtttttgaactttttgttctggtaaaggatatcgccattagcgccttgtcccggtttcttgccttcgccggtaaatactttcattgcattgtcttctataacccagttcgcgggcatagcggttccgttacattgacgccatcctgagaagtcttttccgttgaataataattcccagccagcttttttctccttcttagtcaatgtattcggagtttgagcgatacaggggatagccatagctatggctgaaagaatcaagaatgatttgaacaaatttttcatgttacttaaattgttattagattagatttgttaatatcattacaaatgtagcaatttgcttaataacccttatgaggattaacgtatttttaatggaaataggattattctatattagtgtcatcttcaataccctttagaaagtcggataaagagatatttaatgctctggttattttaattaaggttccgattttgatatcttgtttggcttgttctaatataaaaatattgacgtcggatctgaacatcagttcacgttgtgacatactacgttccttgcgtaaagattttatcctttgcacaatacgttgtattattattttgtcactctcgtttatcataaatagagtaacaaagtatgtgaagatttttatgtaaatagctatagtatattatagcataggtctgtttttttcgtatatttgcggtggctattgatcaaatatgctgatctgcgttcatgtttttgttgtattcattaaaattgataattgcaattgcaacgcatttgcttgtttagttaaggtggttttcatttgtgacaagcagtaaagacatcctgtcagtgattgatcggatgtttttttgactgctggagagtgacgtttttataagccatcccgtacttctgtctgtaaacaagacagaatatggggatagattgacaaactgttaaaacgaatccgaataacagacagggcatctgcgatcaataatcaagttacgattaccctccggtaatgtgaggcatcttaccggactctattgatttaacacatgaatcgtatggcaagccactagcgcagccgtttccgtacgcagccggctctctcctaaagagatcggctcgaagccattctcttgagccagcttgatttcttccgggctaaaatcaccttccggtccgatgaggattaaggcattctctcccggctgatacgtatgttttaatagtggcttctcgccttcctcgcaatgggcgataaacttacgcccgtcaaagggagtggcgacaaacttcttgaaatctgtcattccttctaacgccggcaaagtcgctttctgggattgcttcatggcactgaccaatatcttctccaatcgaatcggcttgatctctttacgctctgagaaacgacaattcaaacaggtgatcgcattgatccctatttccgtcgctttctccacgaaccactccatccggtccatgtttttggtaggagctatggctatatggagattgaagttccagagatcgggttgtttccaactctctaagagggtcacctcacaatgtttgggatgcgcccggctaatagccgctttataaaaagagccttgcccatccgtcaatactatctcatcgccttcacctagacgaagtacccgtatacaatgtcctgcttcttcttccggtaattccggcttgatagttatatctggtgtataaaaaatctgcatgaccatctaattttcaattctcaattctcaattacccaaggatcataccaattatagtagccgatagcacagagaccagggctccgccgatcatggccggtaggccgatacgtgaaattaatcctcgtttttccggggctaatacgcccaatccgcctaataagataccgatagacgatatattagcgaatccgcaaaggatataagtagacatcaagatcgatttctcatacatgaataatccggcatctttccattgctgcaattggaaataggcgacaaattcgttcaatatggtcttttgtcccaataaagaaccaactaacatgatgtcttggctgggaaccccgatcaaccacatgaaaggagaggtgattacgcccagtataaattggaaggtcaagccctgcgccttaccgtccgtaatctttacaatccagtcgttcagtccggtataacgtcctatcacaccttccgtaatataattcgctaacgctacaagggatatgaataccaataacatcgcggcaatattcgtcatcaactttacgccggtaaccgtacccgatgagatggcatctagaatattcgagttctctttttccttaccggagatagctacatggtccgtggcttcttccgtctgcggacaaagcattttcgctaaaacgattgaacccggtactgccattacggaagccgagagcaagtgagtggcgaataaaaccttcgccgccgggtctgttcctcccaacatacctatgtaagtacccattacggaaccggcgatcgtacccattccggataccatgaccaaaaatatctccgaacgattcatcgtcggcaggtaattcttgatcaacacaggagattctgtcattcccataaaaatattaccggcggccactaatccctccgagccggatatattcatgaatttacgcaatacccacgcaaaggcaccgactactttctggataatcccccaatggtaaaacatggaaaccaaggcggagaagaaaataacaatcggtagcgaatgaagcaagaaactgaatcctgccgctttagaggcatacgggcctaataagaaagtaagaccggcatccgtgaagtccatcaacttaacaaatatcttgccacatccttccaataggattccgacgaacggcacatataaaaccgccaaggcgaatacgatctgcatgaacaaacctccacctactaatttccaatcgatccgtttacggtcataactcatcgcataggcgatacctaaaatcgtaatgattccaagcagacctcttaaaagtgagaccagtccgaatcctccttgttctccaatcatttgtttgtgtcctcctcttcttctcgacggcgcaactcgtctttatacattttcgcgtattcgtaattttcgtcggctatagcgtcttccaatcgctcgtttatttcttggatatccaataggcttaaccatttctttaactgggcttcgtccttaatctcatccggttctaattctaataaattgtcatcctcctccggttcgtcagcggggatggacagggtgtcttccagtacgacaccgcattcctttacaatctcctcggaagtaaagatgtcgcaatttacgcgaagcgctatggcaatcgcgtcggaagtacgagagtccagctttatcgagcgctcaccgtcgctaaactctaattctgagtaaaacacaccatcttcgaatttgtatatgtagacttccttaagaatgacgttgaaggcttgcgcaaaagtggcgaataagtcgtgtgttaatggacgaggaggtacgatatgctccaaagcgatcgctatagactgtgcttcagcggtgcctacgatgattggaattcgccgtggaccattttcctctgccaaaattaacgcataggccccggattgaatttggctgttcgctaatccttgaacccttaattttattcttgtactcacagatctgaaatttaaaattgtatacaaaagcaaaagtaatattattttcgggattatcgcgaataaatgtgattaatcactttcagtgtgtttggggttaaggggaaggataatggaaaaacggcttccttttcctatttcggactctacggcgatatacccatcgaaacgttcggctatcactttgcaaatggatagtcccaagccggtacctttggcgaattcatccagtttcgtgaaacgattgaaaacggcgtcttgcttttctttcgggataccaatgccggtatcttctacgaaaatatgtatatgccgctcttcctctcggtattcataaccaatcaatatatatcccttttgcgtgaatttgatagcgttgctaagaaagttggtaatcacttgtgtcaaccgaagcttatccgtgggaatggatatgcttttttccggtatttgcatacgaagttctacgttctccggcattaaaacttggaaagtctggtaaatcgtgcttattaattcatttagagaatattgctggaaagagaatgacatacggcccgattcgatacgggaaagatctaagatatcattgataaggttcaataacagatcgctgttcgtattgattaactcggtaaagttttcccgttctgccttactgagctcgatgtctgtgttcataagattcgagaatccgacaatagcgttcaatggagtccgtatctcatggctcatattcgctaaaaatgccgatttcatttggtcggactctttagccttctctaaggctacttccagttccttgttctgttttaccaaattggcttgtgctaatttcttatatttctgttctctggaatatagcttccataatcccgtggcaacgatattgataaagatgaacgctacgcaaatgaaagcgattagctgtttcttgtatagctcataaaaagggatattgactaaacgggcataagaagggatcttctcgataggtattccccatgcttttatggtatgccatacgagaatatattctttactgctttctttgatcggaatttctgcgacaggggtccctttcagcactaacgaagccatttccgcctgttctcgtgcttgtatttctacggatgtgaaataacctccgatgtatcgattccgtcttttagccggatgatattgaatcggttcgtaatgagcggagaagctgggataattgactaattgataaaaagcttcggaggtatgatcgtattttatatctagataagtgctttgatccagagtgccggacaaattaaagagcaaagaagatcccggtaaaactcggtatggaagggtatttatttttgctatacagttttttcccggtagcgaccgcatctgagtgccattttgggtaaggtctatgagcctctttacaaatagactgtcatttgttccgattttatctaactctagcccccggattttaaggcggattatttctatttccgggtgtccttgtatttgttgccaaaagtcattaaaggattttcttccaaggattgtccggtcgcaaggaatctggatttgcaatactccgaataatttatgtataaattctatattcttgatgaagtcttgtttgtcgtgtagtccggtaacattggggtacttctttaaaagcgaccaattcggataatttacgccggcgaaaacaatcggtatttcttttagatacgggtgcccgcaagctaataaagagtagcaagcttgatcatcgtttactaatatgatatcgggtttaatctctttgatcgagtcaatataattatacattcgggctatttcggcactatccagatattgctcacaatctagatagaatgtatgaatctccgggtttaccttttgtttatcgaatgttcgtttcagcgtttcattaaaaatcgggtaggtatctttcttttgctcaaaagaatggataagcacgactttcttttcttctttttcttggcaacctaaggctaacaaaaaaacaagaaatatgggtattgtgagaactagatatttatgtgtgtgtttcatgactctcaatagatagatctttcgcaaaggtagaagtttttttgattatcaaagcaaaaaaatggtcatccgtcacggacgaccaatcttcattgctaaccttaaatctaataccatgaaaaacacggtgcaaatatatagcattttatgttgtacagcatgatttcgtggcgcaaatccttgatacgttagctttattttaataatagtccttcctgctaaaggaccgttaacagttattgcttgcttttcacgtactcatcggccttctcttttacccgatcggcacgtttttgagtctcgggatggcttgagaacatctgcataaacttggacgatttagcttctgactcactcagttgtaacaatttatttaatgagttagacattccgtacggatctcgcccgttatctatacaaaactggaaaccgaattcgtctgcctcatactcttgtttctgggaatattgagcgccggccaaggcctgtgccatgtctcccagttgagagtcggtcagtttggatacggttccacttacagctccggcggcgtttttagcggcggcggtcaagtaagcgtttttcatggcgtctttagagtcggaatgaacgacgtgcccgatctcatgaccgataacggcgaatacctcgtcatcgtccatgattttcatcaatccgccacatacgcgtacacttccgtctccacaggcgaaagcgtttacatctactacattatatactttaaaatttaagtctaggccggaaactttctttacattggcggtcaagcgttccaagcgttgtcccatttccgtatccggacctgctacctcgttatgagtgtccatccattggatgtactcttttgccattttggctacatcctcgtcggatagagtagcggcatgcgctacatcagtcgcggcattaatcacttttttcgtattaatggtcttgccgccaatcttgaattgggcggaaaccgttaggctcactcctgctaagaaagccaaggacaataagatttttttcatgttttaaattagttagttgtttgtgataaataattttcgatctgttgaaaagtagcgtctttcaacaatacttttttctctttgtttaatagatataatgtgggtatcgcttttaagtcgtagatctcgtcgtttttaagcgaaacacttttgtcgtatgagttgatccaatctttaggcatgacggaaacatgctctttccatgcgtccagatcctcgtccggataaacggctaagatctttagtttgttgctttttgaaaattcattgatcaagaaggacgattccatttgtctggttatttcttgacaagcatggcagtccggattatagaaaaataataatagataatccgcttttatattgtataatttcccggtttttccgttcgctaatgtgtacgtgaaatcggtcgcaggcgtcccgattctgttttttaatgcgagctctagcaaatgggcgggacgtatcttttccacatcgcttaatgacgaggattcggtaagatattccaataccgctatatacatttcctcattccttaggggggagttcgggtcgtatagatatttctccatcatctcggaaaagtactgaaacatggcactgtcttgttctgtttgtttcatcatcgcttttacggaagaagacatagccacaggcgagacatagttcatcaaatctatatagttggataatgcctgctcggtcacttgaggttcatggatataggtcgtatccttgaagtcgaatttatcccaataatgtttcactaaatattcggccctttccactgggtccgtgattaaggtggggaccgagaccatttcaaaggtgggtggcgctacattggattcctccgttttttgattgcgttgaccactgcatgcgttgacggtcaacgtcaacaataaaacatatagatatttcatattcattcatatatttatgtttcaatccacaaatatatagtattttttttatctttgttaaattaaaacagcaaaaggtagaatatcatggattttcgattaaaagtatttcatagcgtagcttgtaacttaagtttcacgaaagcgtcccgggagttgttcattagtcaacccgctattagtaagcatatccatgagttggaggttcaatataagacgcttctctttgaacgaacaggtagccagatccgtttaactcgtgcgggcgagttgttgttttcgcatacccattccttattggcttcgtatcgtcaattggatttcgagatgaatctgttgacaaataattttctgggggatttacatttaggtgccagtacgacaatatcccaatatgttcttccgcccgtgcttgctttattcattaagatgtttccggatatacatgtatctgtattgaatgggaatagccgggatatagagttggctttgcgagatggaaaaataacgttaggattggtggaagggactacccgtcaaaatacgatgcattatataccttttatgaaggatgagttagtggttgtcactcatgtagggtctaagttggctgcttatgacgaactgacgttggaacaactttgtgctttgcccgtagtacttcgtgaaaacggctccggtacgcttgaggtcttggaggggaccttggcaaaacaccagatcaaactgtcgcaattgaacgtattattgcagctaggtagtacggagagtatcaaattattcttggaaaattccgatgctttgggaattctttctattcgggcggtgacacgtgagctgatggcaggacgtttgaaagtgatagaaattgagggctttaaggccgaacggactttctcctttgtggagccgcaggggcagaacagcggtatggaagaaagtttcatgcgttttgccagtcaacattggcaataactttaggttattcgctataaaaacttgtgaagtaagggatcggatgaaaatatgtactttcgcgaacgaaatcaaataatgatatgttgtactaaataaatcaataattatgtttagtgaaaaacgaggtaacgtattacatggtgtcttgctgatagcccttttctcttgttccgcattctatatcgcggagttccagtttattaaacaattgtcattcagtccgctgattgtcggcattattttaggtatgttgtacgccaacagcctgagaaaccatttgccggagacgtgggttccgggtatcctgttttgtactaagcaagtgcttcgtgtgggtatcgtactatatgggtttaagctgaccttccagagcgtgattgcgatcggccttccggcaatcctgatcgatatggtgatcgtggtgcttaccatcttgatcggtgtttgggtggggcgattgatgaaaatggataaagaccttgctttactgaccgccacgggtagcgctatttgcggggctgccgcggtattgggcgctgaaccggtcgtgaagtgcgaggctcataagacggcggttgccgtatcgacagtcgtgattttcggtacgctttctatgtttatttatccggtgatgtaccgtgcgggtattcttgatttagaccctgagcaaatgggactttatacgggtgcgaccttgcatgaggtagctcatgtggtaggagccggtaacgctatgggaaaggaaatttcggatgcggctattatcgtgaaaatgattcgtgtgatgatgttagctcctgtgctagtggtcatgagtttcatgttggctcgaactgctgtgaagtccgtggttaacggggggaggaatggcggaggcgttgccccttctcgtggtaagatcactattccttggtttgcgtttggtttcttggccgtgattggtttcaattcgctcgacttgcttcctcatgcggttgtagatgggatcaatcaggtagatacattcatgctgacaatggccatgactgctcttggtacggagactagtatcgagaaatttaagaaagctggcgctaagccctttgttttggccactattttatatgtttggttactagctggtggttatttgttggcgaaatatgtgcctcaacttgcataagatcgtattttcctctatttttgtgatcttaaataggtcgttgtggataagatgagtcttttatccataccgtgaaatataaaaagatggcatcaaagattacaaaaggtatccttatttcttgttggatagtatacctcgctatattaggggcggtggtaatggtgtttatggcgatagcgaatggttcaattggttatatgcctccggtggaacaattggagaacccgattgataaatatgcttcccaagttatctcctcggacggaaaggcgttgggagcctatgcgcatagcaaagacaatcgtatttacgtgaattatgaggatctttcgccggatttggtgaaagccttgatcgctaccgaggatatccggttcgccgaacatagcggtattgatgcgcagggtttgtttcgtgccatcgtgaagcggggtatcttgatgcaaaaaagcggtggtggcggtagtaccattacccagcaattagcgaagcaattattctcgccgagtgccgataatatgatggaacgtcttttccagaaaccgatcgaatgggtgatcgcggttcaattggaacgttattacacaaaggaagagattataaatatgtatctgaataagtttgacttcttgtacaatgccgtgggaatccaatctgcgtctcgtgtgtatttcgggaagacccctaaaaccttgaagatcgaggaagccgccacgttggtaggcatgtgcaagaacccttcttatttcaatccggttcgccataacaagcgtaccatcggccgtcgtaatacggttttggagcagatggaaaaggccgggtacataaccaaggcggaatgtgattcgttgaaggctttacccttggtcgtacattttacccgtatggaccataaagacggtttggctccttacttccgtgaataccttcgtctgacaatgaccgcgaagaaaccggagcgtaaggattacgcctcttggcaatctcagaaattcagtgaggactcattatcttgggcgacgaatccattatatggatggtgtaacaaaaataaaaaagccgacggagaatactataatctttatacggatggcttgaaaatctatacgagtatcgattcccgtatgcagaaatatgcggaagacgctgtccgtgaacatatgagtaaagatcttcaaccggctttcttccgggaaaagaagggacgtagctatgctccgttctcaagagacgtaagtgtcggtcaagtagacacgatgttgatgcgtgcgatgcaccagacagatcgctaccgggcgatgaaaaagagtggaatggctgaggccgatatgcgcgaggagtttgagaagcctgtcgatatgcgtgtgtttagttgggatggtccgatcgatacgatcatgtctcccttggattcgattcgttatcataagagtttcttgcgtacggcgtttatgtcgatggaccctcgcaccgggcaggtcaaggcttatgtaggtggtattgactataatgacttccaatatgatatggtgaatggcggtcgccgtcagatcggttctaccatgaaaccgttcctttattcgttggcgatgatcgaggggatcagtccttgcgaccagatgctacatgtgcagcagcagttgatggacgagaacggccgtttgtgggttccccgtaacgccagcgcgaagcgaatcggcgagatggttacgatcaagtggggattacagaactcggataactgggtaaccgcttatctgatgagccagctctcaccttatacgtttgttcgtttgcttcattctttcggcttgaagaatcatatcgatccggttatctcggtctgtctgggtactccggatgtatcggtgggtgagatggtcggggcctatacggtatttgccaacaagggcatccgggtagaacctttattcgtgacccgtatagaagattcatatggaaatacaatcgcgaactttaccccacagatgagtgaggtgctgacggaagatgcttcctataagatgctacatatgttgaaaagcgtaatcgacggtggtaccggaggacgtgtacgtttccgctacggtatcaaggcggagatgggtggtaagaccggaacgacccagaataactccgacggttggttcatgggatttacgcctagcttggtttccggctgctgggtaggcggcgaggaccgttccatccatttcgaccgcttggcggaagggcagggagcgagtatggcgttaccgatttacgccctttatatgcaaaaggtttataaagataaaacgttaggctactcggaagacgagactttcgagatccccgagaaatacgcgaacccatgtagcgaaggaggggaggaagatagccccacgaccccaccggatacgggaggtatcgataagatgtttgagtgataataatcagactattacagtttttttaaattccccgtaaggaaaacttttgtttccctatagcaaaacaaaagtttcttcagcaggaaacttttgtttcttccaatagaaactgcagttatctttatggaaaacagaaagcgctactgatcctttttcccaaatcctttgttatactaagaattaatggttagatttgtaactgttaatcttaagaaaggaggagctatatggaccgtagtaaaatgatttctcagttggaagacccgtctgaagtctttgattttcttgtgatcggaggaggggctaccggcataggtatcgctctggatgcttcgacaagaggatatagagtcgccttattcgaacaatcggactttacgaaaggaacttccagccgtagtacgaagttggtccatggcggtgtccgttatttggcgcaaggagatatctccttggttctggaagccttgcgggaacgaggcctgctacgccagaacgctccccatttggtaaaagatcaaaccttcttaatcccttgttatcgttggtgggaaggcccgttttatacgataggcctgatcctatatgatgtgatggccggaaaattaggtctgggacgttcggtttgtatcggtccgaaacgggcgctccgtaccattccgatgcttcgttcgaaagggatgaccgccggggtgctttatcatgacggccagttcgatgattcccgtcttgcgattaatatggtccgcagctctatcgacgctggcgcttgtatcttgaactacgcgaaagtcatagggcttctgaaggacgacgaccgcaaagtatccggcgttacggttcgagatgaggagaccggtacggtttatcaagtaagatcccgttgcgtgatcaacgctaccggtgtcttcgccgatgagatcttgcaaatggacgagccgggtaaacgcccgaccgttcgccccagccaaggagtccatttggtattggattcctctttcttgcaaagtgattgcgccattatgattcctaagacatcggatggacgtgtgttgttcgccgtaccttggcatgataaagtcgtggtagggacaacggataccttgatggaatcgccggaaaaagagccggtagccttagagaaagaaatccaatttatactcgatacggccgctaactatttgacccggccacccaagcgaagcgatgtcttatccgtgttcgcggggcttcgtccgctcgccgctccccgtagcgaaggtaaaaagacaaaagagatatcacgtagccataaattgatccgggagaaatccggcttgatcaccattatcggaggcaaatggacaacctaccggaaaatggctcaagataccctagacctagcgatacgttacatgcatattcctacaaaagactgtattaccgagcgttaccaaatccatggtagccggaagaatccggatttctccgatcctttatacgtatatggtacggatgccgacgaaatccgtaacttagtggcctcttcccccgccatggcggagaagttgcatccggactatgcctatacggtaggagaggtaacttggctggtccgtaatgagatgcctcgtactttggaggatgtattggcacgccgtttgcgtatcttattcttagacgcacgggcggcgatggcgatggctcctaaagtagcgggaattctggctacggaatgggggaaggacgagacttggacctctgctcaggtaaaggcgtttaatgaggttgcctcgaattatatactgaattgacaaattgataaacgatactaatatagaaggatatgaattttcgaaataaatatgtgttggcgatcgatcagggaaccactagctcccgggctatactgtttaatcatcaaggaactattattacgttggctcagaagccattccaacagtatttcccgaaaccgggctgggtagagcacgacccgaatgagatttggtacacccaatcgtctgtcatcaaggaggcgatggcaaaagcggatgtcacggatagccatatcgcctgtatcggaatcgctaaccaacgggagactaccatcatctgggaccgggagactggctttcccgtatacaacgcgatcgtatggcaggatcgccgtacggcggattattgcgaggaacttaaatcgcaaggctgggcggaacgtatccagcagaaaaccggattggtgatcgacgcttatttctccgccacgaagataaaatggatattggataacgtaaagggtatccgggagcgtgcggagcggggagagctatgcttcggtacggtagatacttggctggtttggaaacttacccggggcgctcaattcattacggatgtgacgaacgcttcccgtaccatgcttttcaatatccgtactttgcaatgggatcaagagttattggacttgtttacgatacctgcctcgatgttaccgcaagtgaaagcctgtagtgaggtttactgcgagacatcaactcctatttttaagaaaggcatcccggtatccggtatggctggcgaccaacaggcggctctgttcggtcagctctgcgtagaggatggtatgatcaagacaacctacggaaccggctgctttatgatcctgaataccggcaaggaacccgttctttcccagaataacctattgacaacgatcgcatggaaattaggggatcagacgacctatgcgctggaaggtagtgtctttgtgggaggtgccgtcgttcaatggttgagggatgggatcggcttgattccgaatgcctcgattacggagcaaatggcgaaatccgtcagtgataatgggggtgtttattttgtgccggcgttaacgggtttgggtgcgccgtattgggatcaatacgcacgtggcgctattatcgggattacccgcggaactacggcggctcatttaacccgtgcggctttggagggcatctgctatcaagtatatgatgtattgatggccatggaaaacgatattcacgccaagccgaaagagattcgggtagatggcggtgctatcgctaataacttcttgatgcaattccagtccgatatctgccgctgtccggtcgtacgtccgaatgtattggagacgactgctttgggagccgcttatttggcgggcttggcgatcggctattggaaggatatcgatgaactgaaagaacaatggtgcttggataaggtctttaacccacaaatgaaagaggataccgcccgtaaattattgaacgaatggcataaggcggtggggcgttctcagaattgggctgaataatgaaaatcatcttataggcagattaacaagttaacaaattcttaaattattatcttatgtctccatttttagcggaattattagggactatgctcttgatcctgatgggaggaggagttgtagcgaatgtctgtttgtcgaaaacaaaaggcaatggagcgggctggatagcgataacgaccgcttgggctttaggcgtatttatcggtgttgtggtagccggcccttatagtggcgcacatttgaatccggcggtatcgattggcttggcgatcggagggactttcccttggtgtgatgtatgtacttatatagccgggcaaatgataggtgccgctttgggcgctttattggtctggctggtttataaggatcacttcaacgctacggatgatccggatgcggaattaggcgtattctgtacgagtcctgctatcaaagattatccaattaatttcttaggtgagatgatcggtacgttcgccttgatgtttgtcgtattttttataacggacggagaactaacctacgaaagcaatagtaccttgccgataggtttaggttcggtaggtgccattccggtagcgtttacggtctgggtaatcggcctttccttaggtggaactaccggttacgcgattaaccctgcccgtgatttagctccccgattcatacactttattttgccgatcaagggaaaaggcagcagccattgggagtatgcttgggtacctgttttagggccgatagctggggccgctattgccggtatgctctattatgtattgaaataatctcttgtatcatccggatcactttcggaaccgcctcctttacctcgggtgtcagatccattccgacctcgttgatattgagggcggagatgacaatgagatgggtttccgggagatcgtcggttaggatcatggcgtcgatcatatcttttagaccgatctcgtgggcgctcatgagcgggggaaagtcggtggcgtaacgaggttggatcagacggacggtgcccggagggttattatccagcgtggcgtcgatcatgatgatacggtcatatccttgcagccaacttaataaatgaagtcctcccgtgcccccgtccatcaaatggacgtgagccgggagcttctcgttttctaaagccttgataacgtgtatgcctacaccttcgtctttcagcaataaattgcctactcctaatactaatgtttccttctccactttcatccttttttagcgatcttagtgatagtctcggcagtctcggttacctcttccttgtccgctatgtcttcctcgataaacttccagccaccgatgatggacgaagtctcaccacgttgctcgatatagtcatgataaaataccagataaatatgaacgatagcgaaaaggatgaagaaccacatcaggaaatgatgaatctggcgagccatcaaatccccgcccatcaacgggatggtccatgcgaacaattgcgggaagaaagactgactcatcttggcgtataggccgaatcctgtgatactttgtaacaaaaatgcccagaaagttccgaaataaatcaagctagccaaggcgttatgcccgatactgtctaccggtttgttcttaatcatcaagatatctaccttgatcacctccaatacctctttccattgggatttctttaaagggatgaagttattccatctggcataacgattcccgacgaatccccaataaagccggaatacgaaattgaagaagaatacgaacgctgttacaaaatggataaaccgaaccacgccgaaccaatagctgaaataagcctccgaagcggacatgatcgcgggaggatcggcgatgataaagcctgtcacgcagagtatggcgatacagagcgcattcacccaatgatagatacgtacgggtaattcccatacatacacttctcttaaacgtttcttacgactcttcatggctctattgttttttagaatgtatcaacttggtgcacatattttccttcctcgtcatacagatgcacggcacaagccagacaaggatcgaaagagtggatcgtccgaagaatctctaggggttgcttcggatcgtatatcggcgtaccgatcaaagcggactcgtaggcggacaatacgccgttctcatccctcggtgaggcgttccaagtagtaggcactaccatctggtagttctttacccggttcttgtcgatcacgatgaaatgggctaatgctccacggggagcttcggccaatcctacgccttgctcatgatcgagccagttctcccgttcccattcggcactgtttgccatccgggaatccccgttctctaggttcttgatcaattggttgaaaaactcaagggcccagtctgctgccattctacattccaatccacgagcagcggtgcgtcctagggtagagaataaagcatctaccggcaagtcgagctgacgtaaagtctcgtctacgatactcttttggggttccttccctgcggcgtaagctacgatcaaacgggctaacggacccacttccattggttcctgtttccaccgtggcgtcttgatccaactatatttatcctctacgtccaataacttataggggggacgagggccagtatattccagatgggtctctccctcgtagggatgcaaaccggctttgtctccttgcgtgtatttataccatgaatgataaatgtactccttgatttcttccggggagttagcgtctacgggatgtaccttgctaaggtcacgatccaagacgattcctctggggatcttataactttccacttccccgagatcgaacaccgggtagtctccgtaagacaaatagtttcgtacgcctccgccaatcttactccatttgtctttatagacgttggcgatcatcaataaatctgggatatacacttgattaatgaaagttttcgcctcctctagtttctgctttaccagagcgagtcgatctgcgttgatcgcattggcctcatttaagtcgatgctgcaaggcataccgcctacgatatagtttggatgcggattcttgcccccgaacacagcgtgtaccttgacgacctctttctgccattccaatgcgtccagataatggacggtagcgataaggttctgttccggcgtaagtttatagtccggatgtccccaatacccattggcgaatataccaagctgcccgctggcaacgaacttctttagtcgttcttgagtggcggtgaaatacccctcggtattctttgtccatggagaaagttgctgggcaagtaaagcggcggctttcggatcggcttttaaggcggataccacatctacccaatccaatgcatgcaattgatagaaatgcaccgtatggtcatgcatgtacaatacggcttgcatgatattacgaaccatactggcgttgggagggatcacgataccccgtgcgttctcgaccgcccgtaccgaggcaagcgagtggatggaagtacatacgccgcaaacacggcctacgaaagcccatacatcccggggatcccggtcttttacgatattctcgatgccccgcaccatggtacccgagctataggcgttcttgatagtgccaccttctatttcagcctctacccgcaggtggccttctatacgggtaatggggtctatgacaattctttctgacatgatagtagtgttttattagatcgtagatttactttccggctcatcattgtcgataagctcttttttccgtatgttagtcgctacggcatgtacggcgataccggcggcggtagcggctcctagagccagaccgatctgatccgccgtggcctcgataccgaatccgtgtatatcgggcatacgtttatagaacgggctgttgtcccagaaattctcctcgctgcaacctaaacaggggtgaccgctttggattgggtaactggtgccctcgttccatttgatgataccgcacgagttataggtgcttggacctttgcatcccactttatacaggcagtagccatgcttggcgttctcatcgtcgaagctctccacgaacaaaccggcgtcgaaattcgcacggcggtagcacgtatcatgtacccggcgtgagtagaacatcttcggacggcccaatccatccaattgtggcatacgatcgaaggtcaacatatagataatgacacccgccatcacgtcggcgatcggaggacagccttgtacattaataataggtttacctttgatgactttatggatacctttagcgccggtaggattcgggttcgccgcttgcacgcaaccggcggaagcgcagttgccccaagcgatgatcgctttagctcctgcggcggcctcttcggtgatctgcaaggcactcttgccgcctacgcaacaataagcctcgtcttttgtaggtaacgatccctcgatcatcagcagataattgccgtaatattttttcatggtctcttccttagcggcctcggcctgttcgccggcggcggccatcagcgtctcggtatagtctagggaaatcttgtctaacaacaaggtagccacgatcgggtgagcggcacggataaacgattcggtacaacaggtacattcctgtaggtgtagccagatgatcggaaggcggggtttcgtctccaaggcatttactacctgtgccactcccgaagcctccaatcccatcagggcggccatggtggtacagaacttcaggaagtcccggcgggagatgcctttctgacggcactcttcgtaaacggacggtcttttattttccatatctcagcaattaagtattctaacaaatacgggggagttgctccccgcttagcatatcgatgatccggtagttaccgtataatgtcttcatcttgacccgggcttgctctccgctttgcttggtgatacggccgataacggtcgcttgcctgccctcctcaaaacgtctcataaggggtaacgcttgttccgcaaggctttccggcaggatcacaagaaccaatccttcgttcgctatatagagtgggtctaatcctagcatctcggatgcggcacgtaccgcttccggaataggcagggcgtcttcgtccagcaggatatccacaccagcgtcttgggcgatctcgttgagggttccgcttacgccacctcgggtggggtcacgtaagacatgtacctctcctatagtatgtaacagctcagaaatcagaatgtttagcgaagcggtatcactttttagatccgtctcgaatcccaagctttcccgtgcggaaaggatcgtgataccatgtagaccaatcgggccgctacaaatgacgacatcgccgggagtcgcttggtctggggcgattcgtatgcccggagggacgatcccgatcccactggtgttgataaacaatttatcgcatttgccccgttccaccacttttgtgtctcctgctacgatctgtacgccggcacgctccgccgcacgtttcatggattgtacgatacgctgaagatctgctaggggcaagccctcttccagtataaacccggcggtcagatacaaaggacgggcaccacaacaagccaaatcgttaacggtcccgttgatcgccagatcaccgatatctcctccggggaaaaagatcgggtctaccacgaaggagtcggtagagtaggccagtcgcccttcttccatagggaacacgcatccgtcatgatcctgctccaataatgggttccggaaagccggataaaatacttggctgatcagttggtgtgtcatgcgtcctccccctccgtgcgctagtaacacacggtctgagtcggtaaaaggaatcgggcaattcaagtgtatattcatatctttctatttatatctataataagcggcacaaaccccttccgaggagaccatcggggctcccagcggatgggtgggatggcaggccttcccgaaatggggacagtccgagggttgtctcaaacctctcataatcagaccggcgatgcattcggatgcgatctggttttcttccggacacaattgaaatctcattcgggaggaatatcttttatattcggaccgaagttgaagcccgctggaggggatgattccgatgccccgccagtcttggtcgcaaggttccagcatctcgtccataagttggcgggcggcggcattcccttgttcggggacggcccgtttgtaagcgttctctacctcataacttccggcttccaactgggagacacagcggtagataccatataatagatctaccggctcgaatccggtgacgaccatcgggattttatagtgggcggctaatcggtgataggccctgttgcctgtgatggcgcagacatgtccggctgtcaggaagccattcactttgctttccggatctgataagatagtctcgatagcgggtggtaccgtgaataaggaagtcaatatggaaaagttcggaagtcctcggcgtatggcctctttcaaagccatgaggtggacaggtgcggtcgtctcaaaaccaatcgcgaagaatacgatttccttatccgggttctccttggcgagtgatagggcatccaagggcgtatatagcatacggatatccgctcctctcgcttttacgctcaataaatcctccttacttcccggaactcgcatcatatccccgaaagaggctaagatcacattcggctgtgtcgccaacttcaaggcgtagtcgattgtctcgaccggtgttacacagaccgggcaacccggcccatggagcagttgaagatccggcggcaacatctcttccagccgataacgggcgatagcatgtgtttgcccgccacaaatctccatgatataccaaggtcgtgtcacctttttgcggatggcctccagaagagtttgtaccttctcgttgcttctatattcgtctacgaaacgcacttttgtaattcttttaggtctttcagtgtttcctccgcttctttctcatctaccacggatatagcgatccctgcgtgagcgaggatataatccccctgtttcacatccacccattcaatacatatattctttaggatgcctccgaaatcaactttagccatggtcatttcggggatgcttcgatcgattgagataatctttccgggtaccgctaaacacatatcgtttcaatttatttaataacctcaaagatacttaatatgtttaagagggaaagataaaattgataaatattatttataagatgatggataatatctctttagtaaatacgatagtcgattcgtgtctgattagacatttattcctatatttgtgctatggcgaagaataaagtatatgcgttgattattcaaggcttggttcaaggggttggttttcgtccttttatctaccggatcgctaaagatctggggatgaaaggttgtgtggagaatatgaataatggagtacgtatcttggttgccgctactccggatgatcgggatttgctgataagtcgtatacggaccgagcatcctcgtgtcgcttatatccatcggatctcctatacatctacggaaatggatgaagatgattttgacgattttacgattacgcctagccattcagaatcggatgaggtcacgcaggtctccccggatatcgctgtttgtgcggattgtatgcgagaccggactacgcaaccccatcgaatcggatatccttttattaattgtacgcattgtggccctcgtttctctattatccgggaccttccttacgaccgttcgcagacaacgatgggcggtttccttatgtgtcccgattgtgagaaagaatatacgaatgttatcgatcgccgtttccatgcccaaccggtcgcttgcaatcattgtggcccgacttattatgcgacttataacgaggagacttatatcgattatgagaccttattgaaacttacctctcgtctattgcttggtggagaggttattgcggctaaaggaatcggaggctatcatttgatttgtgatgcctcgaatgagagagcggttgcccgtctgcgagagataaagcagcgggataccaaaccattcgctgttatgttccgtgatctggaacatctgcaagtctatacggtaacggagccgatggaggagcgatgcttagtttcttggcgccgtccgatcgtactgctgaggcaacggagccggttagcttccggaatcaatccgggcatgcatacgctaggatgtatgttgtcttatatgccgattcattacgattggtttgctcgtacagggatacctgcgttggtaatgaccagcgggaatctaagcgatttgccgatagcgatcaccccggaggatgcggaggcgcaattagcgggaaaggtagcgatcctcttgcatcataatcgcccgatccataaccgggtagatgattctgtattgcaggtctgcggaggacaaccttgcttgatccgtcgttcccggggctatgtgccggaaccctttttcacggatacaaatgtggaggggatcatggctttcggtgcggagaaagtgaacacgttcgctttggggaaaggagagacgatcctgcaaagtcaatatattggcgacttaaagaactgggagactttccggttctatacggaatctatggagcggtttcgtcatttgtttcgtttcaatccccagcgattggtttgtgacctgcatccggattatctttccagccaagaggcggaacgtatctcgaaatctctttccttacctttattaaaggtacaacatcatcatgctcatgccgctgcttgtatgttggagcatggattgaatgagccggttctcgctatcgtgatggatgggacaggtctgggtgatgatggtaaggtttggggaggcgagttcttcttttgtgaccgagcgaaataccgtcgcctttcccattttgagtatgtcccgttaccgggaggcgacaaggcggctgaggagccatggcgaatggttgtcgcctatttgtggcattatttcaaggacgaaccgtcgggtattccttatccggccgatttcgtggaacgcataggtacggaaaggatcactatgcttgaacgaatgatggagaaaggtgtgaatacaccctatacatccagcgctggccggctgtttgatgcggtagcttctttattggggatttgcgatgtctccagccaccaagcggaggctccggtcttattggagcaggcggcgatgggagagaggaacgcttatgcgtatccagtctcggcggagggagaggaaatctctttttattctttgtttgaggcattattgcatgataagacgaacgaggtcccggtgagcttgatatccgcccgtttccatacgacattggcttccttgtttgtgcagaaagcccgcttgttgattaaacggacgaaagcgacacaagtggttatctcgggaggatgtttccagaataaattattgacggagtcgatgaggagacagttcatcatggctggggtccccatctatattccgtctcgtataccttgtaacgatggggggatagccgtggggcaattaacgatcgcctcggtgactcccttttaaaagagatcagatatgcatgagttgtctatagcccgtagtatcgtggagctggtcgaggaacaagcggataaccggggagcctcggtggtcgaagagttggagttagagataggacatttgtccggcgtagagatccaaaccttagcgttcgcattggatagcgccataaaaggtagcaagctggaaaaggcccggattatccgtcattatattgagggggaaggacagtgtagcgactgtgagaccattttcccaatgaacgccttgttttccccttgtccccattgtggctcctatttagttaaaatccttaaagggaaggaacttcgggtgaagtcgattgttattaaaaaggaatgatatattaatgaaataaaaacttaaatactatgtgcggaacttgcggatgcggagagcatcatcaccatcacgatcatacgcatgagcattctcatggccatgaacatcatcaccatcctgatgaagggatcgtaatcaatctggaacaagatatacttcaacgtaacaacttattggcggagcgaaaccggggatatttcgaggctaagaacctgttctgcctgaacttgatgagttcgcccggatccggtaagacaaccttgctggaagagacgatccgccgtttgaaagcgaagcgaccgatctatgtgatagaaggcgatcaacaaacctcaaacgatgccgaccgtatagcggcgttggagattcccgtgtttcaggtaaataccggtaccggctgtcatttggaagccgacatggtcaatcatgccgttaagcatctgaatccgaaggagggagcgatcctttttatagagaatgtcggcaatctggtctgtccggccatgttcgatctcggagagtccaagaaagtcgttatcgtgagtacgacggagggagatgataaaccgttgaaatacccacatatctttcaggaggcagatatctgcgtaatcaacaagattgatctggctccttatctgaatacaaaagtggaagtgcttcgggaaaacgccttgaaggtaaatcaccatctccagatattcgaggtgtccgccacgaaaggagacgggatggatgcatggtgtgactggttgcagacagagagtgcaaagtgtaaataaataccccgggttttaatgaataaatggagaaaaaaactatatttgctcccattcattgaatctaactaatcaaaatgttatgattaaccgagaattgattaatcctcaaagcatcgtagtggtgggaggttccaacaacgtacataaaccgggcggtcgtatcgtgcgaaacctgttggatggaaaacataaaggagaattatgtgtggtaaacgccaaggagacagacgtgcaaggcgtcaagtcttatccttctgtacatgatatcccggagacggagttggcgatcatctcgattccgagtaaatcgtgccccgaggtgatggaagtgctggcccggcaaaagggggtaaaagcttttatcgtgatctcggctggcttcggcgaggagacacacgagggcggtatcttggaacaacagatgctggatgtcgtgaatgaggcgggagcctccttgatcggcccgaactgtatcgggttgatgaatatgaattatcatggcgtgtttacgcaaccgataccggaattccatcccgatggcgtggatttcatctctagctccggcggtacggccttgttcattatcgagtcggcgctgacaaaagggctgcgtttctcttctgtttggtcggttgggaactccaagcagaatggagtagaggatatccttgaatatatggatcggaactttgatccggtattggattccaagatcaagatgttgtatatcgagcaaatcaagcaaccggataaattgttgtatcatgcgtcttccttgatacgtaagggatgcaagatcgccgctatcaaggcgggaagtacggagtcgggaaagcgagctgcctcttcgcatacgggcgctatcgctagttcggactctgccgtggaggctttgttccgtaaggcgggtatcgtgcgttgttttagccgtgaggaattgactaccgtggcgagtatctttaccttgaaagacgtgaaagggaagaattgtgcgatcgtgacacatgccggagggcctgcggtaatgctggcggacgctttatccaaggggcgtttgaatgttcctagtttggaaggccctatcgctgatgagttgaaatccaaactgtatccgggtgccgctgtcggtaatccgattgatattatcggtacggggacaccggaacatctggctacagccatcgatttctgtgagaatcgtttcgataatgtggatttgatgatggtcatcttcggtagtcccggtttggtaaaactttatgatacctacgaggtgcttcataaaaagatggaagagtgtaagaagccgatcttcccgatattaccgtctatcgtgacggccggaccggaggtgaagagctttgtcaagaaaggccatgtgaacttctcggacgaggtgacattgggtaccgccctttcacgggtgatcaatacgccgaaaccgatgagcacggatatccagctatatggcgtggatgtaccggaagttcgtcgtatcatagaccggttgccgggtagcggttatttaaatccggaggaagtgcgtacattgttgcgtgccgctaatatcccgttagtggaggaatatgcttcggatgatagggatgcgttgctggcttttgccaagaaggtgaaatatccggtggtagccaaggttgtggggcctgtgcataagagcgatatcggtggtgtggccttgaatatccgtggagaagagcatttattgttcgagtatgaacgtatgatgcgtctgccgggtgttacgggcatcatggtacaaccgatgttgaaaggacaggaattattcttgggagctaaatatgaggatcgtttcggccatgtggtactttgcgggttgggtggaatcttcgtggaggtattgaaggatgtgtcttatggtttggcaccgttatcatatgatgagacttattcaatgattcgttctttgagagggtatccgatcattaaaggtacgcgtgggcaaaagggcatcgacgagcaacaatatgcggacattatcgttcgcctctctaccttattgcgttttgccagcgagataaaggaaatggatataaatccgttggtggctacggatagaggcttgttcgctgtagacgcccgtatccgtatagagaaataataatgattcaatgtgccaatatgcgaatatgctaatatctaaattatccacttctggtatttcattggcatattggcacattgaatcattatttcttcttcttctttttcttatcgggaagatactctttcagaaagcgtttgaagctacttagcgatacattgtatttctccgctatctgggcgtaagtcaagctcgggtctttcaagtctttctcgatttgttccttataaggctccaagcgtcccatttgttgactacctttcggacggcccagcaccacacctttacttctgatcaaggcaagggcttccttcgtacggatagagaccagctttcgctcgatctcggagaccagaccgaaggtaaaggccaaagtcttactgtcgatattatcctcgaacacatatccgtcgcttacgctacgaagcgttacctttcgctctatacaaagcaaaatgatatggatgatctcgatcatcttacggctcacacgggatatatcggacacaagtatctcatccccgggacttaaagatttgacaatactttccagtctgcggttcgcacgaggactatttcccacctctttagcccacttcccgatctctatcttctgagattcggcaaattcccggatcacagcttcttggacctcggagttttgcttattattatatgttcggataaaagcaattgtcataatgtatatatttaattatctccttttaataacagatcgacttacgataagttcaaatatgacaaatatatgaaacactttaattcggttggcttaaaaacaaaaaaaccaactaataaatttattagttggctctttgcggaagcggggggattcgaacccccggtacccttacgagtacgtcagtttagcaaactggtggtttcagccactcacccacacttccttgtgtgttctgtgcttcttccttagaattgcgatgcaaaggtagaactataattttaaataaacaaggctttgcacatcatttttttcgaaaaaagatactacttttgtgccttattctgatattcaatagattattcatggatttgaacaaacaaattttatcgaggcgcccgataattatcgccttgatagcgattctcgttgttttgataggcggtggaggcttttgggtgtaccgtttggcttgggctccgaattttaagccggataagacggtctatgtctatatagatgataaaaaggattttgatgatctttgccggcagttgagggattcggcgaactgtctccgtatcggtagctttaagcaattgagtggattgttgaagtatcctgcgtccatgcgtaccggtcgatacgccgtgaagcccggcatgagtaatttaaccttattgaatgacttgcggagaggacatcaagttgcggcccgtgttacttttaataatgtccgtttcaaggaagatttggcggaacgtataagtgatcaattgatgttcgggaaggaaaatctcttgcgtctattgaatgattctgtgtattgcgactctttaggttttaccccggaaacgatcaatgccctcttcattcctaatacctatgagatttattggaatatatccgcggataaatttatacgtcgcatgaagcgtgaatatgacgctttctggacaccggaacgattgaaaaaggcagaggagatcgggcttactccagttgaggtatctatcttggcttctatcgtagaagaggagacggcggcatcggacgaatatccaatcgtggcgggcctttatatcaaccgccttcatgctggtattcctttacaggcagaccctaccgtaaagttcgcggtgggggatttttctttgcaacgtatcttatttgagcatttggaaatagattctccctataatacctataaatatgcgggcctgcctcccggtcctctacggattcctactatcaagggcttgaatagcgtattgaatcatacgaaacataaatacttatacatgtgcgctaaggaggatttctcgggacggcataatttcgccgtgacgttggcggagcataaccgcaatgccaaccggtatcgggcggagttgaataggcgccggatacggtaatggatctagtataaatcataagtctctcattctaaattgaacatttttcattacctttggcggctaaatagtgtgaatagtcaatattaagaaaacagatacacatggaaaaacatttatttttgggggacgaggccatagcgcaagccgctatagacgctggaatctccggggtatacgcatacccgggaaccccttctactgaaatcacagaatatatccaaggttctccggtaacgaaggaaagaggtatccattgtcgctggagcgcgaatgagaaaaccgccatggaagccgctttgggtatgtgctatgccggtaaacgtgcgctttgctgcatgaagcacgtgggtttgaatgtagccgccgattgctttatgaacgccgctatgagcggtatcaacggaggtatgatcatccttacggccgacgacccatccatgcactcttcccagaatgagcaagacaaccgtatttatggcaatttcgccatgatcccgatgtttgagccatccagccagcaagaggcttatgatatggtatatcatggattcgagttatccgagaaattagggtatcctatcttgctgcgtgtaacgacccgtatggcgcattctcgtgccggtgtcgtaaccagcccgttgaagccggagaaccggatgaattgtccggaagacggtcgtcaacgttttatcttactcccggcattggctcgtaaacgtttcaagagtttgctggcgtctcaagaggctttcacggaagcttccgagaattccgcgtataataagtatttcgatgccccgaataaagacttgggtatcatcacgacgggtatcgctttcaattatctttccgagaattatccggacggtttcgagcatcccgtattgaagatctcccagtatccgcttccgagaaagcaagtggagaagatcgttggcgagtgtaaggagatcttggtgctggaagaggggtatccggttgtcgaggagcaattgaagggtttcttggcgaaaggcgtgacggttcatggccgtctggacggtacgcttcagcgtgacggcgagcttacgccagacgcggtaggcaaagccttgggtaaggagatccagagctattacgcgatccccgaggtggttgagcaacgtccgcccgcattgtgccaaggttgtggacaccgggatatgtatgaggccttgaacgaggtgatcgccgagtataacggtacggctaaggtgtttggcgatatcggctgttataccttgggagctttgcctcctttccgtgcgatcgattcttgtatcgatatgggcgcctccatcacgatggcgaagggcgcttccgacgcgggtgtattcccggctatctccgtgatcggcgattctacgtttacccattccggtatgactggtttgctggattgcgtgaacgagaacacgaatatcaccatcgttatctccgataatgagacaacggccatgaccggagggcaggattccgccggaacaggacgtctggagtctatctgcgccggtatcggtgtggatccggctcacatccgtgtgatggttcctttaaaaaagaacttcgaggagatgaagtctatcatccgtgaggaaatcgagtacaagggcgtatccgtattgatcccccgccgtgagtgtatccagacattaaccagaaagaaaaaagcaagcaagaaatgaaaacagatattatactatcaggtgtaggaggacagggtatcctttctatcgccgccgttattggagaagccgccttaaaagaaggtctgtatatgaagcaggcggaagtacacggtatgagtcaacggggtggagacgtgcagtctaacctgcgtctttccgacgagccgatcgcctcggacttgatcccgaagggccacgccgatttgatcatctccttggaaccgatggagagcttgcgttatctgccttacctgaagaaagagggttggctggtgacaaactcccgtccgttcgtgaacatcccgaactatccggagatcgagaaagtgaacgccgagttggacaagctccctcacaaggtcgtattggacgtggaggagatcgccaaggaagcgggttctgtccgtgccgccaatatcgtgatgttgggtgcagctgcaccatttatcgggatcgagtatgataagatcgaggcgggaatccgtcagatattcggtcgtaagggcgaggatatagttaatatgaacctaaaggcattgaaagccggttatgacttagcgcaaagtttgcggtaaaatctttctccgggtttgcatgatatcagcgtacgtgacatctccgggtttcacgtacgttttttttaacatctaaccccctagaacttttagaagagctgtcgaggggtaggtacagcatcgtagaactttcgtaagccttagaattatgcggtttgatgagaattttaatgtatctttgtcgctgaatcctaaacgagaaatgattaaggttatgaagaagtatttattggctagtttactagcgttattggctttcgtaggcaaagctcaggaggataattccgatatcgtgaaggtcggtgataccatgccgtcatttacgattgtttccgacaacgggagtaagttgcagtccgcttcgttaaagggaaaagtgatcctcgtgaattttttcgccacttggtgtcctccctgccaaaaagaattggcctctgtccaacaaaccctctggccgaaatacaagaacaacaaggacttcgttctcttggtgatcgggcgtgagcattccgatgccgatctacagaaatataacgagaaaaaaggcttcgattttcctttgtatcccgataaggaccgggctattttcggcgctttcgccaagaacttgatccctcgtggctatttggtcggaaaagacgggaagatcatttatacgagcaaaggctataccgatgaggaatttgctgagttaatgactaaaatagagggtgcgttaaaataagaatcatgaaatatagtaacatacatttaatttatttttctccgacacacacgtccgccaagatcgtttacgcgatagcggaaggaatgggtgccacttcgatgtccgagtcggatgtcacttgtgagagtctggatatggaagagtatattgatgatgagctgacgattatagccgctcctgtatacggtggccgtgtggcggagactgccatggaacgttttcgcatgttccgttctgcccaccatgcgccggtagtccccgtggtactgtatgggaaccgggattatgaggatgccttgaaagagctctgtgatttagtgtcggaacaggggttcgtacctgtggctgccggagcgtttatcggcgagcattctttcagccgcaaggggatgcccattgccgaggggcgtccggacgagtcggatcttaatcaggctacggaattcgggaaaaagattatcgaggagctggagaaggtttcctgcgtggaatgcttgtccgccttggaggtgaaaggtaatttcccgtatcgggtgaaaggcccttccactcctcaagctcctgttacggataatgatttatgtacgcaatgtgagtattgcgtggatgtgtgtcctacacatgcgatatccttggcagacgagggtatgtatagcgacccgaacctatgtatcaaatgttgcgcctgcgtgaaagagtgtcccgagggcgcacgtactttcgatactccttacacggcgatgctccataagaactttagcgcgcgcagggagccggagatattcttctaatggaggaccgggcatccggtatattgtgagggaaagcgtcaaaaggcaaaagttcttttggcgctttctctttttttgtacctttgttcggatcgttaatctcaaataataccgtgtttgtatgaaaacctatttattccttttgctttttgtgtttcaagccttctccctttcctcccagattagcctgaaagggtataatcaggagaagatcgatccttctcttttcgagggacgatggaaagcccgttggatctcctacccgggtgaggccccgaatgtatatggggtctatcattttcgtaaatcgttcgatctggaggtggttccttcccggtttatcgtccatgtttccgccgataaccgttataaattatatgtaaacgggaaattggtatccttgggcccggcccgtggggatatctataactggagtttcgagacggtggatctggctccttatctgaggaaagggaagaatacgctggcctccgttgtctggaattatgccgagcggaaacctgtcgcccagatcagttacgatcagacgggttttatcctgcaaggcaatacggggcatgaggcggtggtaaatacggataccacttgggtctgcctgcgtaataaggcgtatgctccttggaccgaatggcaggtattggggtattacgtggctggcccgggtgaggaactggaagcctccgcttatccttggggctgggaacaaccggattacgacgacaggaaatgggagaaggccgtacggggcatggagggcgccacgaaaggatcgagagattacccgggacggttgctggttcctagcccgatacctccgatggacagccggatcgagcggctggccaagctccgccggtcggaagggatcgaatgcccgcaaggatttccttactggccaaaagctttgacgatcccggcgaatacggaggtccgcttgcttctggataatgattacctgacgacgggttatttctccttagccttcagcaaaggaaaggaggccgagatccatatcggttattcggaagccctctataagcaagaagaggaatcgaccactaaatcgtatgcgttgaatggcaagggacatcgggacgagttgacggataagcagtttatcgggtacggggataagatactggctgatgggggagataatcgtctcttcacctccctgtggtggcgtacatggagatatgtggagttgaaagtgaagacggcttccgagcctttggtgatcgaggatatgtatgggactttctctgcctatcctttccgtaacgagaccgctttctccgctccgggacatgaggagctgggccgtatgctcgagataggatggcgtaccgcccgtctgtgcgccaatgagacgtatatggactgcccgtattacgagcaactgcaatatttcggggatacacgcatacaggcaatgatttccatgtataatacatcagacccttatatggtgaagaatgctctagagcaaggacggcagtccatggtggcggaagggattacgatgagccgatatccgtctagcgtacatcagtttatatcctcgttctctctctggtggatttgtatggggcacgattattggatgtaccgtggggatgaggcatacatgaagaccttgcttcccgcttaccgtcaggttttgtcgtggtacgagcaatggttgaagccggattatagtttgtcgtacgttcctcattggttcttcgtggattgggcggccggttttgattatggcgagccgatacgggagaaagagggaaactcggcgctccaagatttgatgtatataatgaccttggagtttgcggtggagatggaacaagcgatcggcctccctgccatggcggatcattaccggaagatcgctaccgagatgcgtaagacgatccgcccgaaatattgggacgctgcccgtaatctattcgccgatacgcaggatcatcgcagctattcccagcatgtgaacgccttggcgatcttgactggggttacgaaaggggaggaggccgtaaaggtgatgaaccaaaccttggcggatacgagcttgatccagtgtacgatctatttccgttattacttgaatcaagcgttgaaagtttccggtttaggggatcagtttttggataacttacaaatatggcgggatcagatggcgttgggattgaccacatgggcagagatgccggagccatcccgttctgattgccatgcttggggagccagtccgaatatcgagttttaccggatcttgttggggatagatagcgatgctcccggatttaggaagatacggatcgctccgtctttgggaaaactgaaggaggtttccggtacgatcccacatccgcttggaagcgtgaccgccgcttataaattggatgagagaggtgagggaaccgcccgtctggtcttgccggaaggtactacgggtatatttatctggaatggaaaagaaatcccgttgaaaccgggcgaacaggttatttcgttatctttgcgtcattaatctatctaaaatccttatatgagacgagtttattcaattgccttattgctgctggtcgctctcggtctgtcggcgacaacgaaggaagtaaagttgaaattagtggaaaccagtgatatccatggaaacttcttcccgtataattttatcgagcagcgggagtggggaggaagtctggcacgggtatattcgttcgtgcaagaagaacgccgggcgtatggcgataaccttttgctattggataatggcgatatcttgcaaggacaaccttcggcgtattattacaatttcatggatacggtctctacgcatatagcttccgccatgatgaattatatggggtacaatgcgggaaatatgggtaaccatgatgtagaggctggccatgccgttttcgatcgttggatcaaacaatgtgatttccctatcttgggtgccaatattatccgtacctccgaccgggagacctatttaaagccctatgaggtatttgagcgtgacggtgtgaagatcgttgtactagggatgattactccggctattcctgtatggttgccggagactctgtggcaaggtctttatttcgccgatatggaagagacggcccgtaaatggatgaagatcattcaggagaaggagaagccggatgttgtggtaggtatctttcatgcgggaaacgaggctcgtaccatgtccggccagtaccgtgaggatgcgtcgatggaggttgcccagcgcattccgggcttcgatgtggttatgatggggcatgatcatcgccggtattgtggtaaggtggcgaatatcgagggagattccgtgttattgataaatccggcaagtaatgggcgtgtagtcggttccgttgatgtcgtgttaaagatggagcatggaaaggttttggacaaacaagtatcgggtgttttgacggatgtggataagttggagcctagcaaggagtttatggagaaattcgctccgcaatacaaagcggtgaatgattttgtctccgagaaggtgggaacttttacggagagtatcgcgacccgtcccgcttactttgggccatccgcttttattgattttattcactctttacaattggagttgactggtgcggacgtctcttttgccgccccgttatcctttgacgcaaaaatagataaaggggatatcacgatcagcgatatgttcagtctttacaaatatgagaatatgctttatacgatgaatttgacgggagccgagatcaaaggtttcttggaggaatcatacgctatgtggaccaaccggatgaaatctccggacgatcatgtcttattattgaaagagagaaagaaaggacaggagaattatgtctcattcgtcaacttcagttttaactttgactccgcagctggtatcatttacaccgtggacgtaacgaaaccagagggtgagaagattacgatcttgaaaatggcggataacaggcctttcgacgagaataaaacgtataaagtagctctcaactcttaccgaggtaatggaggaggtgagttattgacgaaaggggccggtattccccaagacgagttaaagagtcgtatcattcattcgaccgataaagacctccgttattatatgattcaatatataaaggaaaagggcgtacttagcccacaacctttaaaccaatggcaaatgatcccgcaggattggacgagaccggcggccgaacgggattgtaagtttcttttcggggaatgagtttccgtccttgaagtgtctggtttgcgatagtatctcaatgggaaacggtggtaaagtcaatggaatagagatggtttctcaatgactttacggccgtgtcccattgacttttttgtatcccgtattagggatgttgctgataggttagggcgcaaggggcgcatctttacgtatgtttctaaaactttttctgtaaataacgtttatacccctcttgtctgtagagtgatgtaaatattatttttctaaaaatgtttctttgaaagcgtaaagatgcgccttttgcgccctaggatttttaccggggaattttcctgatgccttaacatgtggatatacagttgtttgtgtgcttcttccctcttcggctttttgggtctttggggggcgatataatgggtccttacccacgtttacgtgatccgaaagcactaaaaccaagtgcatttcgcatgatttcatgagctaaaagccgttttttctgtgtgatttcctatcggggccaagatcgtttttgtcgttttcatacgtgcaaatgtactcgtggagcacttgttttaagtgcacgtggtgacacgtgaggccacgtggtgggccatgtgagccgagaatggatatcgacgtattattaatgtacgcgatccccctcgtgaaaaaaacttgaaaaataataccggaaaagtttggaggttatgttttataacactacttttgcacccgcattcgagagagaacgccggtacaaaatgatgaaacaaggcatgtggatattgtttcttgaaatattcacggacgcctgtcaaacgaatctcattccattcatctttgctggtagagatattgaatagatgaatattaaaatcaaaacctttgatgatttccatgaactcgtcgaaagcaaccaaatctctctggttaaacgatgtagcgaaagcgatattcttagcgtctctcaaatccgtgaaaggaacattctccggtatcgccaatacaggaacccggtttacctcgattacctctccggtcacgctaccgatcagatccatatctttttggctcttacctctcgttcccatcacgatcaatgtcggatgatactccttgctataggcgatgatctcctcttccggcaagccttcacgtagtacataatcgtattttacctttggcaattcgccagaggacatcttccggttgatatgcgtacaaatattctccatatcgatacggacacgttgtaagatatgctgtacggattcctcctcatttacttggtaagctaatgtatctcccatcgggatagcagatggaaaataggggctgaaataggcgtgcatgatcatcacctccgcacctaccgcatgagcgtaattaattcccaactcacaagccttggcggaataatccgagaaatcaatcgggatcagcactttcttgaccgcattaaccttcgcttcttcctcctttggttcctcaaaccacttattgtcttcaataatgcgtaaagcatgcggtaaatcactctccttaatacgcacacgtactcctgccgaaacgacgggctggatctggtttacattatgtatatagacctctatgccttctgtttcgaggattgtcttgagaatctgggctttctcgaacgtgtggatagccaatgtcactaatttatcttccatactcaatacatttttatagatgaaacaatcgggatttatgaattgttgaatataaaaaaatcccaaagcgttctttcatttagctatgggattttttatacgaatgaatttctcttacgctttctgtgcttcggcatcctgactctcggccagtatctgcaaagcacgctcgaaaatagtcgtatcatctaaaacaaccaaccctccgtctggaccgggctcgatatggaaaccacaactccgtccatcttgaaaattatgtccaccgaaatagttacgaactgtctctacctttaatcccagctcatcggcgatgcgttgtgtacttccgtcaggtaacgaatctttaattcttctcagttcgttaaatgtaatcgtctttgtcatggctttcttattttgaaggttaatacttttgtttaatattatggcactaacttagtcatttaatagcattgaaacaaattattattgagaaaatcagctgaaaacaaatatgctttacgacatactcaaccaaactctcttatctaaagcatgataccaattgctcattaaatagagctattaaaaggatggtcaaccaaatcgcataggtgatcaaacgtttccgggtatccgagtaaatggcctccggacgtacccaagaatctaccggaatcaatttaggccttatatagaggtataacagatatacaagatacccgaatagcagaccggataaagctcccggaataatatccgtgataaaatgcactcctaaataaatacgagtataggaagtcaaaatcgcccaaaagaaaatagtccatccaaatagcttattccggaagatcagcgccatcaaggtagcgaaaccgaaagcgttcgccgcatggctggagataaatccatacatacctccccgataaccgaacaccacctttacctgatccataaaatcagggtgatgagtcggacggaaacgggtgaagatgggcttacaaacatgcgaagcgaactggtcgcatagcgtgatcgtcaagactatggccaataagatcaacaaccactccttccagttcttcttatagcacaataccaccaatataaaaaaggctaacggtagccaaaccgccttgcctgaatagatccacataaagcgatctaaaaaagcggagtcgctaccgttaagcataaagaacgcatcacgttcccaaaccaataattgttctagcatgtatcagattttttctatgtctttactaggcatccatcctacgttcccgtcctcaagctcgatctcgctccattcgccaagcgtactcttcacggtcacgttcgttccctcgtgtaatacgaaaagatccgtaccactagcgtcgggcgagcttttcaccgtaacggtcggggcgaatacgatggcatgtttacggtttatcatctcatccttctggtcgctggcgaatatattggcaaaaacaaccatgataataaataggatacccaaatagaaaccgatcttcttcaagcgtacccaacgggagaaaaagaacaagatcaagcaaccgataaacaacaggaagcacacgataccagtcttcgcccaagagtctgcggaaccgaggttctccacgctcttaaaccatttgaccaagaaaaaatcaccaaccggctcaatcttatcgatcgtcttctgacgggccatctgtaaattgaagcgagcatcgctatcacccggatccagcagaagacaacgttcgtagttcaatatagccggagcgatcttacccgccttataataggcatttcccaaattataataaacggcggcagactcaccattgctcttcaagattccctcatatagctcgatcgccttcgcataatcttctttcgtgtaagcgacctcggcctccttcaaggcggtatcttgcgcataagcagatcctatcagacatagagtcaataagaaaaacaatacctttcttaaatttatagtcatcttcatcttcttactttttaattgtattctccattttaccaatagcgtctaccgtcagctcatacagcttatccatagcgtctgacgcttgggacggagcgtaacgagcgaactcacaagtattcaagatatccatgaactcattcgtcaaggattcgtctacaccgtatttagccaattctgtctctacgttatccttggtcagatcggattgcgggatactcagcttatcgctcaaatagccccacaacgcacgcagtacctcgtcgtagaattcttccttcttgttctctttcatcagcttgccggcgttcttcagacgtctaaccgccatcttgttcgccttcttggtacgaaccaaggcgatgtcggcgttttccttcacctgcttacgataaataaagaagaatacgataaacaagatagccggtacgatatagcaaagataatacataaaggaaccgaagaatataccatcacctccctcgataaaggagaagcctttcgtctttaggtaacggatatccttgcctaagtatttcacgctctctttattactgaagttcgatacgaccggggaagaaccgctaccgcccttgccttgctccacatgcaacttataaggctcggacttgatggtcttgtacgaaccggacttgatatcgaaataggagaaagcgatcgccgggatctcgaaatcacccgcgtaacggggtatcgccatatattcgatcgtcttgcttccactgacaccggcagtcgtggtcttgatgtccatctctacttttgggtcgtagacatcgaaatcgttcgggaaaaccacttccgggttcttcaccaacttcacgtttccgttacccgtgattttcacctttatggttacagcctcgtctgtcttgacgttgttcgagctgatatcagccgtcatggagaacgtacctacggcaccggagaaagaagcgggcttaccggagggcaaaggcttcacgtcgatagtaaccggagaggtggtcaacaccttgctcacatcccgatacgagtcgaagaagctatcgaagatactaccgccacccgcttgttgcatacggaccttcaccacggcgtcgaacttgccactactgatcgtaatctttccagagcgttgcggatacaggatcacttgacgcatcacggccgactggtagttacgtccgttgtagttttccaaggtcagttgtttctcttgcggaagctcgatctcttgcacaagaaaaccctcaaactcaggatacttcaagccagtaattgcgaagttctctaaggaatagaccttgaaagtcaccaagaaaccttcttgctcgaacacgcttcgtttggatacgtccatcttcacgaacagccgatcgttagagatcgccccgctcgccgtcgttgtctccgcctcttgcttacccgccttatcagccggaagcaccttgatggccaagccattcgatgtataattagagccgttcaccttgatcgttgccggagctatattaaacgtaccttccttcttcggcatcaagacatacgtatacgtaacggttgtctcgctggtactcttcccgttcacccagctactgctataggaggtggattgggagggacccattaatacgtcaaagtctggcatctcctgcactctcaaatccttgccttcggcattgacggtgaaagtcaagcgaaactgctctcccattaccaccgcttggggcgccgaggccttgaaggtcacatccgcggcctttgtcgccacccctaccgttaacatcaggatgaataagaaaattaatttcctcattgtgtatctcattttttcgttaattatccagtttaccactccttctcggtcttccggcgttgttgctgctgcatctgcgccttcttcaccttctcttgggtgtctttctcatcttgcaggaaggcgtccaacatctgctgggcattgtccttgctcatttgctcgttggattgctgttgctcttgggtcttatcctgcttctggtcgtcttgcggctgttgttgttgctgttgctgctgatcgtccttctgatccttgttctcctgcttgtcggcgttctgttgatcttggctctgatcctgattctgctgatccgacagcagtttctgggccaaggccaagttataacgggtctcgtcatctttcgggttcaagcgaagcgattgcttatacacctccacggccttgccgtaatccttgttctgcatgaagatattccccatattatgatacacctccgacaagcgtgccttcccttccggcgtagccaccatcttctccccttgcccggcgatcaattgatattgctcggcggcctcggggaacttgccttgcttgtatagggagtttcccagattataggttccttccgtagagcggggattcacctccaagctcttgcgataagcgatctcggactcggtgtatttctcgctctcataaagcttattcccctcacgcacgttcttccgttccgctttctgggcagagaccgccccagcgctgagcgccaagaccgatacccatatcatagatttatatatacgtctcatcacttcgtcgaattaagagaataattttactttcctaaatatacggttcttacgatccaaggtcatgaaatcggcgatcaagaggaacaaagctatccaagcgaaaatctggaactgctcgtcatactcggaataaaccttgctatccagctccgtcttattcattttctcgatttctttctgaagggctttcaaggcagaattcgtattgtccgcacgtacgtacataccgtttccggcggcggcgatctcttgacccatctgctcgttcagcttcgtgatcaccacgtttccatccttatccttcatataattattgcttccttggatggggatcggagaacctttcggatcacccattcccacgatgttcacgtggatgcccttctcggcggcggctttggcggcaccgatagcgtcgtcctcatggttctcgccgtcggtgatcaagatgatcgccttatcggtcgtctcgtccggggtaaaggaacgggcggccaagttgatggcggcaccgatcgccgtaccttgcgtagagaccatcgacgggttgatagaggacaagaacatcttggcggagatataatccgaggtgatcggcaactgcgtgaaagcgtcgccggcgaacacgatcaaacctaccttatcattcgtaaagccgtccgtcaatcgggatagcatctgtttggctttatccaaacggttgggcgacacgtcctcggccaacatggagttggatacgtccagacacaccatgatctctactccctgacgcttcaccgtctccagtttcgagccgaattgaggccccgctataataaagataaccatggtaatggctccgaacaacagccaaaacttcagatgctggcgcttggtcgatacctcgggcatcaactcggccaacaacgtagggttaccgtatttctttatcgctttcttcttcacgatcatggcatacacgtagaacgccaccaatgcgggaaggagaaaaagcaaatataaaaagtccggatgcgcaaatcgaaacataagccttttatctttatggtatatttctcaacaatgtatttctcaataagatctccaccagcaacaaggcgaacaccagcaaggcccagttcttatactcctcctgcttcttgctgtactcctgtacgctgatcttggtcttctccatctggtcgatctcggaatagatctccttcaggctggcgttgtccgtagcacggaaatattgcccgcccgtggtagaggcgatctgcttcaacgtagcctcgtcgatctctaccggtatattctggtactgcacgccgaaagcggtctggaacggatacggcgccatgcctttcgttccgactccgatcgtatagacacgcacgccgaacgtcttggcgatctcagcggcggtaaccggagcgatctcgccggcgttgttcgaaccatcggtcagaaggatgatcaccttcgacttagcgtggctgtccttgatacggctcacggcattcgccaagcccaacccgatagccgttccgtcttggatcataccgctttggatatccttgaagagattcagcaagaccgtatgatcggttgtcaacgggcattgcgtaaagctctcggcagaaaagaccacgagaccgatgttatcgttcggacggccgttgatgaacgacgcggccacatccttcgccgcctccaagcggttcggtttcaagtcttgcgccagcatactacccgagatatccatcgccaacatgatatcgataccttccgtggaagaattggaccaactattcgtggattgcggacgggccaagatcacgatcagcaacgctaccgctaccatacgcaacacgaaaggcacgtgacgcaagtacacgatccatgatgtcgctcccggcgcctcgaacgcctccgacgaggagacctgcaagctggcctgactcttgctcagcttgtagacgtaccatccgatcatcggaatgagcaacaacaataaatataaataattaggattcgcaaataccatctcttaatcctttaaattagttgtatcgttcgtagattcgggctcttgcatctcctccaccttcgtctggttcacgaacaaatacgcattcatcatactcaaatcattctcatccggcagcgggttcatcttggcgaatttcacgaagtcggccaattgcagaatctgcctcaagttatcgtacacgctctgcgcctcagagttcttgcggatcagctccaagatctcaccggaagtcatctccatggcattgataccgaaacgttcctcgatatacttacgcagcgtatccgtgatcaaggtgtaatactccttgcttcgtccttgctgccagagtttctgttgcttgatctcgtccagttccttgatagcctgctcgtgaggcggaagtttcggctcctctttcttgaatgggatcaacgacttcttcgcacggatccgtttcacgatataggcgatcacgcaaatcaagaacagggccagcaagatcccgtaaatgatcggataataatcggcccatacgaaaggcggcttccatacggtcttgatgtcgttgaactcctccggcttgtccgcgttcacgggaatcgtggagaccttcaaggcgacttggttggaatatacggtatccaccccgtctatcaccttcaacggaggtaatagatagagtgacgaatcaaacgaggtaatcaatacatcctgcttgataacgagccggtcgttctcgatctccgtggagtccgccttggagagattcaacacctccacacccgtcatcaaggtatcgttcgggatcacgatctgcacagggcgatccttatccgccgttaccgtaaggtgcaaggtagtctgctctccgatcaatatggcggccgagtcgatagcgacatcgatcaacggtctctgcgcatatgcccttccccccgcgagggaagcggcggcgaccagaaacaggatacttttctttatcaatttcatctgcttgctttaattacgtttgtcaaaaagagcaatcaatgctttcacataatcatcctcggtacggacagagacggagtctacacggcatttcttgaacgtatcgctcatcttcgcctgccgtttctcccaccattccttataggccgcacgcacacgggcggaggaactgtctatccattgctccttcccggtctcggcgtccttgatcttcataaggcctacggcgggaagctcggtctcacgacggtcgtacacctgaatggctaccatgtcatgcttgcggttggccaccgtcagggcgtccttgaaaccctccttatcgataaaatcggaaatgaggaaagccgtgcaacgcttcttgatggcgttggtcaagtatttcaacacttggctgatatccgttctcgtctcctcgggatggaaatcgatcagctcccggatgatatataagatatgtttctttcctttctggggcgggataaacttctcgatcttgtccgagaagaacaccacgccgatcttatcgttgttctgtatcgccgagaaagccaaggtagcggcgatctcggtgatcacctccttcttcatgacgttgacggagccaaagtcacggctaccggacacgtcgatcagcagcatcaccgtcagctcacgctcctcctcgaacaccttgacataagggcggacgtagcgggcggtcacgttccagtcgatatcccggatatcatcgccgtactgatattccctcacctcgctgaacgccataccacggcccttgaaagccgaatggtactggccggcgaagatgttacgggaaagaccacgggtctttatctcgatacggcgtaccttctttaataattcgcttgtctccatttaaggaacttctactttattcaagatctcgctaattacctcctcagaagtcaagttgttcgcctcggcctcataactcaagccgatacgatggcgcatcacgtcgtggcataccgcacggatatcctccgggatcacatagcccctgcgcttgatgaaagcgtacgcacgggcggccaacgccaagttgatagacgcacgaggggaagcgccgaaagagatcatgctcgccaagttcggcaaaccagcctcagccgggaaacgggtagcgaagacgatatccacgatgtaacgctcgatcttctcgtccaaataaacctcacgaaccacgttacgggcgtcgaggatctcctctttcgttaagatcggcttgatctccggacgttctccggatatattctggcgtatgatcagtttctcctcctccttcttcgggtaattgatgatcaccttcaacatgaaacggtctacctgcgcctcaggcaacgggtacgtaccctcctgctcgatcgggttctgggtagccattaccaagaaaggcttcggcaacttgtaggtatgctcgctgatcgtgacctgacgctcctgcatggcctccaacaaggcactctgtactttcgccggggcacggttgatctcgtccgctaacacaaaattagcgaagatcgggccttgctttacctggaactcttcgcttttctgactgtaaatcatcgtaccgatcacatcggccggaagtaagtccggggtgaactggattcggctgtatttagcgtcgatcaacgacgacaatgttttaatggcaagtgtcttagccaaacccggcacaccttccaacaggatatgtccgtccgaaagcaaaccgatcaacaaggattcaaccaaatgcttttgtccgacgattactttgtccatacccatcgtaatcatgttcacaaacgagcttttactttcaattcgctcattcaactcacgaatgtctactgtctgactcataagatttattctattatattgttattatattgtcccaattttacgttgattttttaggatgcacaaaattagaaatgttaaattcgtatccttcacttttgcagttaaataatactaaccaacacttcctcgttttgttttattttacttaaaaaagggggatttctcttactccccggcaagtatctctgtttgtagggcggcggctttctcccgcgactcacggctcttggcatcgatgccatacgattccggtgcgggtatctcgatcacggtaccgatcgggacgttgttcgggtcttttataacagccttattatgttggtaaatatacacccagaataatttattgccataatattccaaggcgatcacggtgaggcggtcgccatgcttgatcttcacctgccccaatggttttggcgccggttccacataaggctccggttccgtatgcggggtcttctccgctaccgagtccggatgaagcatccaagctgattcttgaaccgtgtccttggccgtattcttggcttccgttatcacctcttcttgggcaggcgccggtttccaattatttcttcccagatagaagaatacagagattacgattatcaaaaaggcgacgatcattaatacccccttttcctccggtttcctacgggcttgctcttccggtctctctggtatgggagatggctccgcgggcggttccggttccaatccacgttccggttcagataccgatgacggctccggatcaaacgcttgctctggctcaggcaatggttcaggttcaggttctagtatcggttcgggcttctctttgggctgagtatttgccaaagggatttccttatccggcattacctcctccacggactcgtcttccgtttccttctcctctacggactcatccatgtccgagaaatccacgttctcgttgatctctgtcgtctcaaagatagagaaaggcttgtttacctgttcccgcaggtctttatccggcaggaaagagaatttataatgttcggggatcaagaaacgttcaccggtattcacgtggatactctcccgcttctccacagagataatcttgaaagtacccaagccctttacttttacgatcttatccgtatagaccccttcggataccaccgagataaaatctctcaagaaacgctctacctctcctctgtccttgccggtacgctccgataataaaccggctaaatcttgtatattcagccggttattcatgatcacccaattcctttaaacgattcttcacggtcgttccgggcttgaacacgggaactaatttagggggaaccagatatcgcttcccgttcgccggattcacggaaatacgttccgctttctttttcacctcgaactggccgaagccttgcagatagatcgtatcgttatccactaatttcgaacttacgacggaactgagcgcagaaagcatgtcggatacctccttcgaggtccaatccatgcgattcgccaattccgttataagttccttgtttttcatatctaattccataacagttcgtgctgctatattagttattttttcgttaaccgacaaatatattgacagtttttacatcaattcaacactttaccatacagatcaaacgcttgtgcgtcaatcacctttacttggtaaaagctacccggactcaagggagtatccttggaaatcaatatttccggatctacctcgggcgagtcgtattgcgtacgtcccacgtagaaatcctcctcctcccggtctacgatcactcggaaggtctgccctactttcgaggcgttcacgtcggcggagatgccttcttgcacacgcatcaagtaatccagtcggtcttgcttcacctcctgcgggatctcgtctttataatgctgataggcataggtaccctcctcatggctataggcgaaagcgcccatacgctcgaagcggatatctttcacgaagcggatcaactcctcgaaatcctgttccgtctcgccgggatgacccaccatcaaggtggtgcgtagatggatgcccggcacttcccggcgcatacgctccagcagctcatacgtctcggccttcgtgatattgcggcgcatcatcctcaacatcgggtcgctgatatgctggagggcgatgtccatatacttgcaaacgttatcacgctcacgcatcaccggcaacaggtcataggggaaatgagacggatacccgtaatgcaaacgaatccactccacgcccgggatgtcggatacccgctccaccagttctggcaaggccattcgcttatagcgatcgaggccataaaacgtaagatcttgggcgatcatctggaattcttttacgccttgcgcgaccaagccacgaacctcgtctacgatctcgtccatcggacgggactggtaagccccggttatgatcgggatcgaacagtaggagcaggtacggttgcatccctccccgatcttcacgtaagcgtagtgcctcggggtggtgagcacacgctcggtagctagctcttgatggtacgacttgcccagatcggagatcaactccttccaattgaatttcccgtagaaacgatctacctcgggaagttccttctccagatctttcaagaaacgctccgacaagcagcccatcacgaagagcttcccgatccgtcctttttgtttttgttcgcccagttctaggatcatattgatagattcctcttgggcgtcgccgatgaaaccacaggtattcactaccacgatctcgccattgatcttatggggatcatgctctaccgtataaccgttggcgacgaattggcgcatcaattgctccgagtccactaggttcttcgagcaacccagtgtaataatatctactttgttttttctcattctccaaataacgaattgacaaactcacgtttgcggaatacttgcaaatcctccatcccctcgccgagtccgatatatttcacggggatacggaaatggtcggagataccgatcacgacaccccccttggctgtaccgtccagcttggtcacggccaaggcgttcacctcggtggcggcggtaaattgtttcgcttgctcgaaagcgttctgcccggtagagccgtccaataccaacaagatctcgtggggggcgtccgggatcaccttcttcatcacgttcttaatcttggtaagctcgttcatcaagttgatcttgttatgcagacgtccggcggtatcgataatcaccacgtcggcatcgttcgccttggcggagctcagcgtatcgaaagccacggaagcggggtccgagcccatgttctgcttcacgataggtacgcctacccgctcgctccagatcactagttgctccacggcggcggcacggaacgtatcggcggcgcccagatagaccttcttgccggctttcttgaactggtaggccagcttaccgatcgtggtcgtcttacccaccccgttcacgcctacaaccatgatcacgtagggtttcttgccctccggaagcgcgaatccctcggcatcctccgtattgttctctgtcagcaagctagcgatctcgtcacgcagcagggtggtcaattcttgggtggtgacatacttgtcacgggccacacgcttctcgatacggtcgatgattttcaacgtggtatctacaccgacatccgaggtaatcagtacttcctccaaattatccaacacatcgtcgtccaccttactcttaccggcgatcgccttggtaatcttggagaaaacactttcttttgtcttcgatagacctttatccaaggtttccttcttgtctttactgaaaaagctaaaaatacccatatttattttgtttctgtttttaatccatcctgttcttataatcctcatagccgaacgtacggtacatcaccagctggtcgtccttgctccaaagggccaaggaagggtgcggtatgccgttgaacatattcgtcttcacgatcgtgtagtggatcatatcctcgaaaatcagcttgtcgccgatctccaaaggcttgtcgaacgaccaatcccccatataatcaccgcttaaacagctattccccccgatccggtacgtaggtttcccctccacggcatccgtggcgaaacggatagccggcttgtagggcatctccaggcaatccggcatatggcaggtgaacgaggcgtcgataatcgccgtcttgataccgtggttctccacgatgtccaccacggttgtcagcaagaacccggtctgccaagcgaaggcgctacccggctccatgatcaactccaagttcggatatctttccttaaagcctttcagcaaagcgattaaatgctccacgtcgtaatccttacgggtcatcaaatgaccgcctcccatattcagccacttaacgtgaggcaggaaacggccaaaacgcctctccacctcggccagcgtccgctccagatcataggaagtggactcgcacaaggtatggaagtgcagcccctcgataccctccggcaacgtgtctcccagcaagtcgccggtcacccccatccgggaacccggagcacaaggattatacaagtccgtctccacgtccgagtattccggattgatccgcaacccacaagacacccggttaccatccgcccgcaccatcgggtaaaaacgatggaactgagagagcgagttgaacgtaacgtgactactgtatctcaagatcaacgggaaatcagcctccgtataagccggggaataggtatgcgccggacttcccatttcctcgaaggccaactgggcctcaaatttagaacttgctgtcgaaaaaggaatgtactcacgtacgatcgggaacgctttccataaagcgaaagccttaaaagccaatatgatattcactcccgcacgttcttttacgctcttgatcaaggacaggttgtttctcagtaatttctcctccatcacatagcaaggcgagggtatcttgttgatgtctatcatgctgtatctcaatatttcatattaacatgcaaatataagaaaaacattctgatattacaactattatcggggtaattcattgaatatgtcgcagaaaaaagacagttgtgttaacttgcgaatactactgtgttcgtagacaaatactatagtacttgggcacaagcactatagtatttctgggttcttttcattctctttttaatcgaaaaaaaagaaaggaggcatcttgcctctattctttatatttttattataatatctatttatatcttatatgatgcgaaagtgagttcgaaagcccattcgaaaataaacctttccttttctgccaatcattaaaatccaacgacttagcttcaaaaagcagtgttcgattcggcattcgaaaatgaattcgagcaaaaacgcacttagcctaacacgctgagtttggcaaacttaagcaaaagtcgcctttctccgaaattcttgaaggcgaccgtcactttcgcatcacctccctcaccttccatcgagacgatctcgccatcgccgaaacggtcgtgattgaccttctggcccaccctcaaaacagaggcatccgtggctggagccgccgaaaaggacgattccatcgagttttttagcttcgtaagatgcccttgacgctgtgccgcttgcttcaccggcgacacgaaatcatcctcaaccgcccacctatagcgttcacgggccgaggcgaatgcatctgaagcgccggcatccgaaggcatatccagatacttagcgtctatatccttcaagaaacggctgggcgtacacatatccgtcttcccgttacgatagcggctcttcgcatagctcaatacgcaattttgctccgcacgggtaatcgccacgtagaacaaacgacgctcctcctctaccgctctcgggttatctttcgatagggacgaggggaataggtcttcctccaagcctaccacgaaaacattcgtgaattccaatcccttggcggcatgtacggtcatcatcgtgaccttatcggagttttcctctttatcgttatcttgatcggtgagcaaggatacctccgccaaaaagtcggacatggcgacttgctccatcccctcctcacgccggatctcgcaaaactcagcgatacctttcagcaactcctgcaagttctcttgcttgctcacgccctctacggaacggtcttgaaacaggtcggaaacgatgccgctacgcttcaccaccaaggtagccaattcctctgcggagagttttttattctcttcaatgaaaacttcaatcaaactacggaaatcgctcagtttcttagctgtaccattatttatcggtagcgaatattccaagggggcctgaagcacggtccacaggcttaccccgtattcggtagcagcgccaacaagcttacctaccgtcgtatccccgattccccgggtgggataattgatgattcgcttcagggcctcctcgtcgtgcgggttcacgatcaggcggaagtaagagatcacgtccttgatctctttccgctggtaaaaagacaaaccgccgtaaatcttgtaagggatgccccgctttcgcaacgcctcttccaagatacgggactgggcgttggtacgatacaagatagcgaaatcagcatacgagaatttccctaatatcccgtgcatctcgttgattcgggcggctacggtgtagccctcctcataatcggagtacgaggtgaaaacactcaccttgctgcccgcctccttctcggaatagaccgttttgggtatctgacgtgtattcttgtcgatcaagctattggcggcgttcacgatattctgggtggaacggtaattccgttccagcttgaagatacggcaaccggtataaagattcttgaattgcaggatattatctatattagcgcctcggaaggaatagatgctctgggcgtcatcccctaccacgcagatatggccgtgtctctcgcaaagccgttgcacgatcaagtgttgggcaaagttcgtatcttgatactcatccaccaatacataccggaagaagttccggtatttctccaagacggccggatgatcccggaacaggatattggtttgcagcaacaagtcgtcgaaatccatggctcccgcttgcaggcaacggctctggtaacgtttgtagatttcccggagcaaggggaccttggcgttcatatcgctttccacgagctctttattttgctcgtaggccgtataagttatcaaggagttcttcgcgttggagatccggctctgcaccattcctaggcggtacaccttatcgtccaattgcatttccttgatgatggatttcagtaagctcttggaatcagtggcgtcataaatcgtgaaattggaaggataaccgatatgctccgcctcgttccgtaaaatacgggagaagatggaatggaacgttcccatccatagccgacgggccgtttgctcaccggtgatggccgctatacgctctttcatctcccgggccgccttattggtaaaggtcagcgccaagatactatagggaggcaatcccaattgcaataaataagcgatcttataggtcagtacccttgtcttaccggagccagccccggccacgaccaaggatggcccctcattgtaaaccaccgcttcccgctggctctcattcagttgattcaaatactcttccacattcatccgttttagggatacaaaattagggaaaataagcgattccacataaaaaagttgggcaggtcgccgataatatatacatttgcctacatataatcagtagtattaaccaaaacaagggactatgggaaattgggagagacaacagacaatgaggaaagaacgggacaaggtccgaagggagactttagggaagttcttttttgacttggctaaattaatgtttacgacgatggtattaggagaaatgctcctattagcaaaagacatcggcgacattaataattggggtatgttaaatatagggattttaggtacttacctattagcccgagttggaaatagaatattaaaataatatgattatgataaaagatttaaatggattgacagtgttgatgctcgttgttaccattttagccgctatcttcttagcttggctttacacaaagcccggcaagaaatggttggatgagttatgataccgtaggtggtgtgccatattgtggatcatggcacaccatcttctttatttagcgtccaacagatcatcattccttatgctcctccccgctttcttcacgctcgcttttaaatcaccgatccggtagctaatggcgatgccgaaaccacggctaaacatacgctcggtctgccggatatgaaagtccggatatcgctcgttaatctgtatcgtcttatgatctcccagaaaatcttgcgcccgcagcgtacaagtcaatttatccttcaagaagctctttaccacactcaagccgtaaaaataaaagccgtacgagtccatccccacattcggctcggaacgcacgtatccacccgacaggacaaaacgccacccgtacttaaacttctgcgagaaatcgacaaaagcagagccacaaaagccggaattacgcacatccgtatcgtaaacctcattcccctcctgcgcccgtaaatccagataatgcaacatgctgttcagcgacacgcttgtccggggcgaaggattatagcttagataaaggtttcctcccgctgctttcacgtccacgagattatcatacgtactattcaccacattcgccgaatcaatgaacagatactcatcaatcaccccttttcccaaggtgcagagcacggaagcctgcacattcaatttcgttccgtaataactgtatgacgccgaaagacgatgatgtttctccgataccaatcccggatttccatacgagatagaggtcccagacacgaacaccgtaggattcaaatagctgatattcgggcgacgtaaacgtaagttgtaagccaagcgaaacaaattccggtcgtccaagcggaaagcggaggtccaagaaggaacccaatccgttacacgataattaaaatccttgccttcgccttgtttataagtcacgtcctgccaagtatgttccatacgaatgcccgggttcaagctccatttaccatacttaaatccatatcccgcataggcggagcctatattctgcacatgccgatattccaccaaaggttgtaaatcagcgggtaaccagacaccctcacccaactcctttacctccgaagtagcgtggctcgtactgttacgccgaatcagcttcaaaccgccctcgatggaatgcgtacttgtaaaaggattcacgtaatcaagctgggccgtatgctcatgggtacgggcatgactgatttgccgggtataatcggcctccagttggggtaacgagacattacccatcttgtccttatcatgaaacacgctataaatatcgttcgggatataatcgtactgataggaaagcgttagcatctcttccttatttcgtttgaataaacgctgataatccgcttttaaggaggcactaccccattcgttcttcttactcatatcctcgttataagcatagatttcttccccctctttatcaaacctgctataatggctattccaaatagagttgctgtttccgatattcaagtttccggacaaggagatcaaattcaatgtatcgatctcgaaactgccttccagacttccataatgggccggatatttcacgtctacgtccgagagcatccggagcttcgcaccgtctcccgactgagtacggagataatccgactcgctctcggacgattgtaggctaaacgtataatttccggaaagcgataatcggccatatttcagcgtagcgaaaccaccgacactcttaaataagttcatcaccgtagtgtttatacttgcgttatatccctcgaactccgctcctttcgtcacgatattcaagattccgctgacaccctccgcatcgtaacgggcaccgggatctgttatcacctccactttcttgatcatgctggcggggatactacgcaagacctccttgggattattggagaacatattcgagggacgcccgttcatataaatcttaaaactggattgtccgtttaccttcacgttatcctcgccatccacggtcactagagggacttttcgcaacatctccagcaaagtataggttcgggaatccgggtcctcggcgatactgtaagtagtcttatccgcctctgcctttatcaagggtttcacggcgacaatgtttatctcgggcaagtcctcgttcaaatacaatgaatcgggagagacgagttgggcagtcaacgtcgagttccagtttcccacaagccctatcaaggccatcatcatcagaaatcttttcatatccgtatcttatttgatttgttttcgggcaaaagtagaggctacagacaacaacaacgtaaataatcgccggataagtagctgacatttccatgacatttccatgacatccggtcatttagcaggatttatgtctatttcatcccgaatcctatcgaaaaggatactttccttctataatatttagtaccttcgagcgttctttttatgttaattctaatctagcgaataatgaatacacgactatcggccaatctatccgttttgggtacctccttaatgctgatcctctcgttcagcttcggtttccatagttatacggaagccaagaaaacgatcgtgacagacttgaatcaagcgttgcaacaaacgatcctgcaaaattcccacctatggatgagccaagattccatacgcacctatgccaatctatccaagcttttcggcaatccggtatccatagaaagttataacaaggacttttccgacgcattgagttatacgcccgacaagaagaaaacgggaatcgtaatccacgtactcaataaagatcctcaaaccgaaaacgctcccgctaataccaacaagaaactcaacgaatattatatcgccagcgatacgattatctgggcttcatccatagcgaacagccccaatactgccacggatcatatcgggatctcattccaagggtacgccaattgctccacccttgcggttatcgggctatcggacaaatctttgcccggcctattcctcgggcttgcctttttatccgctaccctgcctctattgctcaaacgctatagaaaggaactgataacgcctcaatctatccatccggaaaagatcatctctttcggtaatttgaacctttcttgtgaaaccgcctccttctataaggagaatgaggagaaactaaaactcacccctcagcaatatgccttgatggagatgtttttcctatcgcctacgcatatcttgaaccgctcggatatctgcgagagcttatggccgggaaagatcaacgccgacgagaccttgaacaccttgatccgaaggctacggcctttagtggaggaaaacagtaacctaaagatcacgacagacagaggacgagcttatgcgcttgaaataaaagaggaataaattttgtactccatttttagaatttagcaaaattatgaaatcacaaagaataacaacccccaaaatgctacgcaccatcgagatagcagtaaagaagccgcttcatactacaccgtctatcatccaatttttgcagcaaagcaaatcccaaattatgcagcgtgagaaagaatcagacgttgtattacaacgaatgaggattggttcagaaatccctctgataacactatcagatggcgttgctattcgatggtgggtccaagaaggggttccgggaaaatattcatataaaccatggtattctaatgtatttcgtttcgcttacacacttggcgaacaatacatgaaagaagggaaagagtttaaggatccagcggatgccataaatcatgtttatattcagtttttatctcaaagagaaaatgcttccctcgtgtttcccgataaaaaagaggctaggaaaccggagttagaactacgtacattgttcattaagcagaaaatggatagccaagggtatgttgttctagatgtaaaagaactacaacagaatgacggaaaaaacaatcagggagcatttattgtcacagcactcaataaagatgctatagcatccgataagcctgaatgtttctttgtaaaagtggtcagggaattaaataattttaaagatttgataaagagacaggaaggagtggaagctgctgatcccaaaaagtcagtacctcgtatgactgctgatcagttaaatacttttacttccttaaaagatcattttgatgtgggtggcagggctattggtatctttccggctgtccatggcatcaccttgctggatctgcatcgtaactggttatgtggtagagcttctgatgatgcattgataagcgcttggcataatgtaggaaatgttttgtctcgcttccataaccctaacttacagacattgccttcttctaccagatgcggaggtaagattttgggtggtaagggactttatacccacggagatctaaatccatcaaatataatgatagatgccgagcaaggttctgctatgttaattgatattgatggaggtcataatgattcagaatattccggcttaggaatagaacttactaatctatttgaggcatttgatgtaggtataaaaagaacaaaagggtatggggtggatggatgtataaaggaggctgggaatattgcagaaatgtataaattactgttagacaggtttgaaagtgcatatttggaacgtattataaacaacgaagtttttaagagatttgtgagagatgaaattcaacgtaaaaaagaagggatagaacgtctgattgtgcattgataatgcgcttagcaaactggaagaaatgtcttgtctcacctccatatatagttatatgtcctatttaaggacaaatctcctgttaagttcacacaagataaacaaggagccgtattaaaacttaaggaggcacttacgaatatcgatcatgttgtaaggattgatttctaacaaaaagagcgaccatctctgatcgctctttcctttttatctagatagaattaatatcttccaccatcccggttagaaccataaccgccacctctgttagagccatagccaccgcctctgttggaaccgtagccgccacctctgttgttattgaaacgaccacctctgtcgcctctatcctctctaggtctggcttctgttatattgatgactttgccgtcataacttgcttggtttaactcctcgatagcctttttagctagctcatcatcgctcagctcaacgaaaccgaagcctcttgaacggccggtttctctatccataataacttttgctgaagtaatctcaccgtaatcagcaaataactgtcttaagtcctcatcagagatgttgtaacttagatttgaaatgtaaagattcattttgtaaactttaattaaatggttaattgagctgagtatgtcgactaaaaaagtttacctaacaaatcaagttgtgagcaaatactttctaatactaacttaaatcaatctcaaatatgctgcgaatgtaatggttttattcgagcatacaactataaatccaataaatttcgaaaaaatataagggcggggtctgcccgcccccacgaaattagaatacggtaacttcttgtcccgcggtattcgcacggattaaataatcgtacatcgcctcgcaatacaccggaggcaggtagaagcggcccgggtagactgcgcaaagattgatcttcacggtcacttgactgcctgccggcagacggtctatataactataaacacggtcgtcacgaatatcctgataattcactccggcggtcaggctgtccgtagcagctccattcaggaagcgggtattcagtatttcccatccggcagggaagatctccgataataccaaattattatatccccgggccgaagggttctttaccgtaaccacggcggagaaattcgtaccttgctccaattgggcgacattgaccggacgtccgttcaagtccacatagctaaccgccaacgagacaccgttcgcatacgctttttcctctccctgctccggtattccctcggttatgatacgggcgaagagcgtagatttacccgtgttcttcaactcgacgctcgccgaggtccccgccttatccaataaggtctcggaccatatattcttatccgttttcacctgtccatcctttccgccacaagcgtacgtgaaatccatggccccgtctacccgatatttagctaggtagtccgacaaggcaactaaagcgaatgccgtagattgtgtgctcaaccaatcatccgaagaaagttgtttggacaactcttccaccaaagtagcggcctccttgcctttatccaacaagcaaagcgtcattaactggatggattgatcccggacatcactgccgaacgtctcgtcatactcggaataaccggaaggaagagccgtcgtcttactgatcaggtcttgagcgacatcctcacggccgaccaaggcataggcggaagctagcgaccagcgactcatggaggccaagtctttcatctctttcaagcggttcatggcacccatctccggcgacccggccaaagccaatacatacaggcgataggcttgggtagtctctttcgaatccatataataagaggtagccggcttccaattacgggctacccggcgtagattattcaatacgctttgtttcatggcctcgggaaccaagtagcctttcttcgaggcttccagcaagaaatgagtagcgaaaaccgtaccccagccattgctgctcgttccacccggccaataggcgaaagccccatctacggtctggtaagagcgcagacggcggatcacctctttcacggcctcctccgtggatttcgcctgttgaggggtcaaatccgtaaacgaggagatataaagctgcgggaatcctttcgaggtgatctgttccagacatccgtgaggataacccaacaaataagatagacgtgaggataagttcacgggggcgatatccgacacttccaaagtcaactggttcgtacccgtggcacccggcatcgcaaccgtctctttccaagacttgccggcctccaaggtagcggcggtaactttcacttgcgggcggcgtaccgtacggatctccagttccgtctcataaacggatttatcccctttacccgtagcggttatcgttaccttcccgatacccgggttcttcttcacccggatacggaacgaggcttgctgatcccctttccgctcgaagctcaagctcctcgtcgcctcgccgaccacttccatattcgagctgcaagcaatagatacattcacggcccctacgccatcctcggtagcgaataccgtagcgggtactaccatctcctcgcccacgccgatcacccggggcaaggttcctagcagcattacgggcttacgtaccatcacgctcttatcggcatgtccataagcctccccgtttccggctaccaccatgatcttgacacgcccgttataattcggcatctgataggtatgccgggcggtcttccccttcttcagcaagaacgggccgtcaaatcgcaccacgggcttgaagcggttcacgatcgctttcgggcctttgttcagcgcatcgtcgccgccgatactgaacaactgctcgatacggccgccataagcgccaaccacgtagttatacaaatcccatgtattcacgcccaacgcttcccgggcgttaaacgccttccaaggctccggcgtacggaaacgggtcaagtccagcaagccctcatccacgaccgccagcgtgtaagccatctcctttccattcttctcggagacggagacggtataagaggcatccggtttcagctcggcgggagattggatgaccggggtcagatggctctccggagaagttaccgtgaacgggaccacgccatacaagcggatcggcaaatcgttcttcgtaatgccatgaggctgcaaaagggtgatatagacgtaagcgttcggctgcatatctttcgtcacatccagtctcacggtcgtttgtttatcctcgcacgtatgttccgtcaaggaaaggacacgcacgccgttctctatactgataatcgcacggcttcctttcgtagaggggaaggtgactaccatcttctcgccgggcgtataactatccttatcggtcttgaaactaagcatcgtggcggactcgctgccatcggtgttacgtcggccctcattataaggccagtcgaaataactcatcactcccgtagagtgcttactctccttatctttcacggagatgaaatacgttccccactccttatccggaaaagagagctggaacgtaccccggccgtccccatccgtacggacggtaaatgtctttaccggcttattgtaggaatccgatacgtaattggccagaccgctactgttggagtcccaccaccaataccaatagactttatatactttcacgtctaattccgtattcgcttgcggtttccctaaataatcaacagaagcgacctcgtaggtataattggctccggtatttagttgttccttatctttctgcggagatttgataccagcataccggcgataaggcgagtaaagcatccggtccgcgtcgatactgaaatcgccggattcctcatagacccgggtcactaggtttgccagcaacattccgggagcggtagaacccagctcgaagcgggcttgtaccgtggcatcgccccgctcattggtaacgccggagatcagcttgctctcttccgtattaaatacacgggaaggatcgtcgaaatagaaacccttatagccctcgaaggtagtcggggtagcgataaaggttccttgtatatcatatttcaagttacgggcgatagctccttgcagccattccacatgcaggtgggcatccataggctcaccacgcaacaaggtcttctccggcatggataaggcgatcttcaggcggttcggcttgatggactcgatgcgtaagcgcttcgagaaagagaccccacccacttgcgccttcacattccacgcacccgtgggagcatccgcctcggtaacgaaatcgaagacataaagccccaactcgccacgggtctgcgtcttacgggcatacatttgccctaacgggttgtacagctccatcaccaccggatgctctgccggcaattgcttcgcccggtcgttcagcataaagcccagatgcaacgtatcacccggacgccatacgcctcgctcgccatagataaagcccttgatccctttctggacgacctcgcccgatacatcgaacgaactgagcgagagagccgatccgttatccacccgcagataggaacgttgggttccctgtgaggcgatcaggtagaacggacgtcccgaggagagatccagccgtacctgccccttgtcatcggtcgtgcccgaggccaacgcttggtgttggtaattataggcggtaaccgtaactcctcgctccggctccgtattctgtatattatgcaccaacacggtcatatcattatcctgccccatcaaggcgaccagtcccaaattggtagccaagatattctttccctctaccttattaaagtaataactatccgagcaaggatcgttccattctttccaattataactagaccaatcgtattgacggtaataatacgctccctcgtcaaaacgggcggactcttccttgaaacggatctcgtccgaggccaagatctgctccttcgagatcttcaacgtatcattcccgcaaggataggccgacaaaggccggtcaaacgaaagctccagacggtagatagcgcccggttccggctcgatcaaccgctttaaatcgaccgcgaacgtattccaccgggacaggtcaagaccctcctcatccaagaagatcgtcttacgggcgatcaagcgcccgacacgcattaactccccggactcatccaagttgttcgattgcaggaactgaccgatattctgctccaatatcttgataacgctcaccgtaacccctcgcaaataaatcgcttggaaaggaacggataattgcgtggattgcgggatgatcactcctttcccgataaaacggacgccgggtttctgctcatctaggattatttgacgcacgacagcctctttcaggttcaagccgctcttgctgcggatgccttggttcaggtggatattcatcacgcccttttgccacaaatcggcatccggatataggcgtagcttgtttccgtccacggttacggtctccgacgtattctcggcgataaaggccaagcctctcatatcctggcccacatccaataacttcgtgaaagcgacctccacgtaacgctccggctcggacacatacgtcacgtcgtacaccgagaaatcattctgatccggaacgctcactgtcacgacatcggccttttccacgcctagtttattagaagagacggaaagcttgagtgtccgttccccctccataccggcggagacattgagtaaggtcacctcatgtttctttccatccgggctgtgttgccaagtagcgtctaccttctccgagaaatccaccaacgactccacggtctccggagattccttatccggcgtgaaaagcacggcggtcagatcgtacccattctcgtttttcttgttgatatccatcgattccagattcccccgaagggctaaagggagcgtggtaaaaccaaaagcgaaccacttatccttaccttgtgcctcaaaccattcggacaaatcggctttcacctgataagaggtgtttcgctcaaagcctttctccggcttgaataccaacgtccggttattctcgaaagcccatttccccggcacatcgggcttgaggcgcacgagtttccccaatcggtccgcctttaatcgatccgccgggatctcttgattaaagatcaggtaaacgggagaataccgggaaatcttcccggtagtaaacgcctctacattcggattataaggggggagatcttgatccgcagggcttgtcgtatgacaacttgtcaagatagacaagagacaaagtacgcagaataaaccgatagaccgtatcatacacatgaatgtttaaatggttaatccacaaatgtacataaattataccaagatgcaatgatctatccgtatatctccttttcgaacaatcacttctcaaatatattcgctatatttgcgttcaatgaaacatctaagattgtaaaacaagatcatgcccaagaaactacacaaggaaatccccatcgactacgccgtctgccagcaacaagattgccctcgggccggaaagtgcctgcaccagatcgcctaccggccgctcatcgaacaaccggcaaccgtattacggctgctgaaccccaccctctgtacccgggatgaggcttgcccctacttccgagactccgctcccgtcacctacgcgcggggcttcaccgggatgcagagccggatgttcccggcgcaataccagcaattcatgtcgatactcatgtcccatttcggacgtaacccctacttcgagcggcgaaggggcgaatttccactctcacctaaagagcaaaggatcgtgctaaacgccttgcgaagggtcggagtgacggaagagctaaggttcgatcattatgaggagagtgtcaattggtatgattgaggcagtactccttataaagtaccgcagtactttgcgcacagtactacagtacttcctacggagtactggcagatgcctcagccatctatccaagtcgctattaccgaggccgggacgagtgccatggcgcctcctcgcatccctcttggggatcggcgtgacggcgtggtgtatcctgtatggcatcgtgccccggcaattatttcccgccccctgctctaccttattatattcggccgagggcgagcttttaggcgcacgtatcgcaccggacgggcaatggcgtttcccggcggcggatagcttgcctgataaattcgtggattgcttgctcacgtatgaggataaacggttcttttaccatcccggtatagaccccgccgccatcttccgggcgatccgcttgaacgggaaagcggggcgtgtggtgagcggaggaagtaccttgaccatgcaattggcacgcatagcgagagggaaccaagaccggaccttctacgagaaaacgatcgagatgtgctgggcgctctttctggaaaccacccatagcaaacaagagatactgaacctctatgcctcgcacgctcccttcgggggaaacgtaatcgggctggagaccgccgcatggcgttatttcgggcgaagcgcctccgagctatcgtgggccgagagcgccacgctcgcggttcttcccaactcccccgccttgatccaccccgggagaaaccggaaacaactgaaggagaagcgggatcgcttattggcttcccttcaaaagaaaggtgtattggaggagaccgaatacgagctggcctgcatggagccacttcccgaagcccctctccctttacctaatgatgcccctcacctgttagaaagactggccgcggaacaaccggggcaacgcatccaaacctccgtccgccaagccctgcaacggcagacacaggccctcgtaaaccgttatgcccgtgaatacagttccaaccatatccataatctggcggcgatcgtagcggacgtggagaccggggaggtattggcctacgccggaaacgctacctatccggccgacgagcggcgggggaaccaagtagatatcatcacctcgccccgcagcacgggaagtattctcaagcccttcctgtatgccggtatgctgcacgacgggctgttgctcccctccatgctggtatcggacgtgcccttgaatataaatggcttctccccccataattacaacaagacattctacggggcggtaccggcccatgtagccatagagcgctccttgaacgtgcccttggtacgtatgctctcccagtataataccggacgctttatgtctttgctgaaatcgtggggaatgactaccttacgtttctccgaggaacattacggggcttccttgatcttgggaggggccgagggaaccttatgggatctttccggcatgtatgcctccatgtctcgtgtgcttaaacattaccgtacttacaacggacgctataatccggcggacatccatccgctgactccctttccggcggagaggaaggaacccatccgttcccttaccgatagccggctcaccgataaggctctcctttcctccgcggccctgtggtacacgttcgaggcgatgtctgctctgaaccgtcccgaggaagaggccgactggcaacaattcgagtcgatgaaacggatcgcatggaagaccgggacgagttacgggggacgagacgcttgggcgatcggcacgaccccccgctacgttgtcggcgtatgggcaggtaacgcttccggcgagggccgtccgggacttacgggtgtcggcaacgccgccccggtccttttcgatctcttttccctattgcccggtggcgaatggttcgacctgccctacgatgagacgcttcccatggcgatctgccggaacagcgggcataaagcctcgccctactgcgagcaaacggacaccttatacatgccgctgtccggcaataacacggggatttgcccctaccataagctcgtgcatctatcggcggacggacggtacagggtcaatagttcctgcgagtctgtcgaccggatgatcagccgcccgtggttcgtgcttcctcccgcgcaggagtattactaccgcaactatcacatcgattatatcccgctccctccggtaaaacccggctgcgggcaagacttgaaccgccagatcgaactgatctatcccgagcataacgccattctctaccttccgaaaggcttctccggaaagtccgagaaatttatcttcaaggccgcccacgcccgccgtgacgctacgatttactggcatctggacgaaagctatctgggagagaccaccgagaatcaccagatcagttgctccgtgagccaaggaaaacatctccttaccctcatcgacaacgaggggaaccagaagaaaatacaattcgaggtcaagtaaagcatccgttaagccttgaccttgacccaaacagccaatttgcctcccttgacaaggaaacagcccttcccttcctcatcaatcgtcacggtatcttttaccgagcctgtgatctcatgccatacctcgcctttccggttctcccccacagacattgttttctctccatcttccccgttcgagataaccaccgccaagcccgaatcagcatgtcccgaatctcccaagcgtacgaagccaatcgtgttcggatgatcaaaataatccacctcttccccgtacgcatattctttccgggcacgcaatagcatatccaataccttacgatggggagatttcttcccttttacgccataataatccccataaaagatacacggataccctttcttcatcaacaggatcaaaccgtaggcggaaggtttgaaccaatccttcacctgcgactccaaagaactgtttttctgggaatcatggttatccacgaaggtgacggcttgatccgggcatatctcgaccaaggtcccttttaatagatcgcgtaaatcatagtcacgacctttctcggaagcctcattcaagttataatgtaaggctacgtcaaacaaatccacgttatattctacttgcgacaggtaagcctccaacgattcggtatcgtttttccaatattccccgacagcgtagaaaccctctccccgatccgctctcaccgcctccagaaaatgcttgataaactggtcgttcatatgcttgatcgcatcaaggcgcataccgtccaagtttagttcgttcgatacccagatcccccagtcctgcatctcacgcacgacttcagggttatcgaaatccagatcggcgaacatgagatagtcgtaatttccattctcatcatcgactccctcactccaatgttttccctctcccagaatctggaatataccttccttcttgcgggatacatcatagtccgtcccggagaaatgaaaccaatgccatttaaaattagaatacatattgccacgccccgggaagtcgaagccggtccagccctctatctcatggggttcgctgatagcgttttcccgttgcccaggatctacctcttgcgccataaaccactcggtataatcggctcccgccttatggttcatcacggcatccagatatacgccaatctggttccggtgaagttcctcgatcatttcttgaagttcctgtttagttccatacttggtgcgtatggtccctttttggtcgaactcccccaaatcatatagatcataggttccatacccctcgtccgcttgctcatggcctttgtacgcgggtggaatccatacggcgctgatcccgatctcatgtaaatgcgaggcatcatccttcagccgtttccacagcattccatcgttcggcagattccattcgaaatactgcatcattactccattttccatatgtttcttctatttgttgataaaacaacacttcccaagcgtcataagttgctgaaactaaccaccacatccttttgttatagtaaaaaactaaagaataataagatggattcaaagcatgttacagagagtacgtccggtcaagaggacattcaaaagacttggtggaaagaagcgattatataccaaatctatccccgtagctttcaggacagcgatggcgacggaatcggtgacttaaacggtatcacctcccgcttggattatatacaaagcttgggtgtggatatcatctggttaaacccgatctttctctctcccaacgatgataatggttacgacatcagcgactatcgggaaatcatgagagaattcggtacgatggaagatttcgaccgcctcctgaaagagattcataaacgggagatgcgactggtactggacttggtagtaaaccataccagcgacgagcatccttggttcgaggaagcccgtaaatccagacataatccctattataattattaccattggtggccggccgagaaaggtgagcctcccttgcgcctcagctatttcgacgaggaaggcaacgcttggacgtataacaagccaaccgactcgtattacctgcattatttctcccggaaacaacccgacttaaattgggagaacccggaggtacgccaagagattttcgatatgatgcgcttctggttcgataaagggatagacggttttcgcatggattccatctctcttatcgccaaagatccctcattccctctcatagattccaagaaatatccggatatattttctttctatgccaaagagcctcgcctgcacctctatcttcacgagatgaatcggcaggtattaagcaaatacgattgtatgagtgttggagaaggttcggccgtgatggtagatgatgtcgctaaatttgtcgatccggcccgggaagagttgaatatgctttatcatttcgacgccgcccgtatccggaatacaaccctaccggacaatccggaatccggtatagactatagcttgatcgccctaaagaagatgtttacggaatgggataaggcgatagataagggttggccctcgatctacttgggtaatcatgaccagccccgtatggtcagtcgctttggtagcgataaggatgagttcagggccttgtccaccaagatgcttattacttttctgcttacgatgagaggaacgccttattggttcgccggggacgagataggtatgcgtaacattcggttcgaccgtatcgaggattataacgatatcgatacgatcaaccgctataagaaagcgaaagcagagggtaaagatccgcaggcggtattggacgaacagaaagagaccggacgagacaacgcccgcactcctttccaatgggatcgctcgccggaagcgggatttacggcaggaaccccttggttaaaggtaaatccggattatacttggataaacgtagcggacgaagaaaaagatccgacctccatacttaattattttaagaaagtagtcagcttccgtaaggagaatccgagtttgatttatggcagttatcatttgctggatgcggagaatccccaatcctatacctttttacgcaagactggggccgacacttatctgattatgctcaatttctcccacaaggcggcaatctccactccggggatagatatgagtaacgcacacgtcctattggacaattacggggaccgaagtcatatggcgcctcaaaaagatatcacgctccgtcctttcgaagcgattgtctttcaattgaaccatcccgtctatgaatccttcatcgattcgctagatcttttggaatgattcgttaaaaagaggtacaaagcgcaactaaagacttttaggatgtgtttaaatacaaagcatcagaactttttaataaaatataaaactattcgttatgggatttatttggtctattatcatcggtatcgtagccggttatctggctggtaagattatgcgtggaggaggtttcggggtcattgttaatttgatcctaggtattattggaggtgtattgggtggctgggtattcagcttactaggcatatcggccggtggtatcttaggaagcttgataacctctacggtcggagctattttgttattatggatcggctcgctattcaacaaatccaaagaggtttaagaaggcgtgctcaattatcaaatcatatattacatggcaacaagatctcacgaaactttagttacggcataatataatgtaaaaggcagtcctttgcaggactgcctttttatttagatcgtttccactttttctttaggtaaaacccatttcaataccagataaccgcaaagaccggatataaacgatcccgtgaatacacccagcttcgcctgattcaagagatcggcacccgccgccgtactgccgtcaaaggaaagattcgctataaacaaagcgaccgtgaaaccgattcctcccaacatggatactccaaataaattacgcttgctcatgcctgtaggcatggaggcaaatggcgtacatgcgaacaagtaagagaaagagaatatacctaatgtctttcctacaaataggcccacgaacaccgccaacggtacattaactaatgtctggggttggatatccccgaatgtcacaccggcattcacgaaagcgaataaaggaagtatcacatagtttaccaaaggatgcaacttatcagcgatggtctgcaacggactgatcgttttatctgccaacgtatggatgttattcaatacctgaatttgtgtaggcgtaagcacttccgctttacgggactgacgaacctcggtatagtccagcatattcaaatacccggtcatatcacacgtgaaatcatctagcttaacaaccggacgggctggaaccgtaaaggcgatcaacacgccggcgattgtcggatggattcctgactccagaaatagcagccaaacgataaagccaccgatatagaaaaacaatcggttgtgtacccggaactttcctcccacatacaacaaagcgaggactatcagggatatcaacaaaggctcgaaagcgatatgcccgctataaaacagggcgataattataatacctccaatatcatccaccacagccaaggcggtcaagaagatacgcatgctcaacggcacccgcttccccaacaagcccaatacggccaaggcgaaagcgatatccgtagccatcggaatagccgccccgtttacctcgggaggcgtattacatactaacatataaaataagaccggcacgatcattccaccacaagcggcgataataggcaatagcgccttccgcacggaactcaactcaccgatcaatacctcttgcttgatctccagaccgatcacgaaaaagaaaaccgccataagggcgtcgttcacgaaagccaacatagacatagtctcgccatgatgcgcgaagaagttaaactgcccggcttgcagatcgattggaaaagctaataataaatgatacttatgtgcccaaggcgaattggccaagaccatagcgatgatggtggcggcaaatagtaaaagactggcgttcggcttctgtatagcgaagcgacgcaacggtttaaggataacattaatcgtacggtccataaataataagttagatgaaggtcttcaacaattgatcgtactatgactattcccgtttccctcttgggagggaaacggaatatcatcttgaaataccttcaagtgttttttctattaattgactgctttggcttttcctgcttgctccaggttataagcgctgcgtgtgagtttctctacccagatgacaaagataccagttaaaattaaattaaacacaatagttaacacagaaattatcaacatcgggccacctaatccatatcctaaggctatgaaaataacgccggctcctacctctccacgggtaaacataccgatagacagcgccaaacgctcccgtttcatccggtcacggtagaaaaacaaaggaaataatttaccgatattggataagaatgagacgattacgacgtgtaaagcgatcatcgaccatgacatcatcggctgtgcgcctgtcaccgtagttacttccgccgcttgctgagcgaaatccacacccataaacaccggcatgctcactccgacaaggaacataaagagataagagataaaatcggacacttgatgctcgatcttggtatcgatatgcttatgccgcatgatcatacctacgacaaacgcaggtaaaagtacctcgatatggatgctagcctcctccccgtacatatgtttcgataccagataaatcacttgcgtgataccaaacgtcacgacggcatagaacaagatggctttccagtcttgacgtacattataatatcccattttcttccagcccagaatcaagagcaatactacaaccagaataatgactcccaattgccagcgcaagccgatcatcatgatttgcaacgggatcatcaacaggatcgtatccaagtcgtcgaagatcgccaatacctgtaccttcttatatacccaagaggcttttagcccggcggcggccaacatcgtaaacaagatacccgccgaggtaggcgcggcgaaccggcttagcaacaggttctccttccaagcgtcccaacttccccataaatcgcccggaagcaagacaaacatataatataaagccacgaatatccacggaaacgcagccgtagccatcgctatgaaataatcttcggtataagacttccaccgggtcttatcaatctcgaactcacgccccacattaatcatgataaacgcaaggcaaataaacaaaaatgtattagagatcgtctttaccagcgaatactgttcccccaccatagcgggaagcatttgcgacacgaccaaacccaacactagaaaaagagagaataaaagaacttttttcattcagataaaactatattaatatttacacaataaaatgcaggggcagggttcctcatgagccttgtctctacaaaaaacaattgaaaattgaattagttgatcgcttgctactcttttagataagcggtctcaacctttaacaaacgatttttgaggcgttcagcctctcctttacggatacgaagcgtcatctcgcaatccatctcgaacttctgtgagatgatagcggggttatcctcttttacgatacgcatgatcccgtttaggtatgggtattcgaaaacgaccgtgatgtcctcgtctaccgtacgttcctcgatctctgaggcggcgacagcctcggcggcggccgtgcgataagcgacgatcagcccgctggttcctaactcgattccaccaaagtaacgtactacgacaatcaataaatcggtcagctcattcgagttgatctgtccgaggatcggtttcccggccgtggaagaaggctccccgtcatcgttggcccggaacgtctgccgctctggacctaacatatacgcccagcatacatggcgggcatcataatattgtttacggtatttctccagttgctccttcacctcttccaccgtacgcacggggatagcatacgagataaagcggctgcgcttctcggtataatatccctcggctacttgcttgatggtcttgtaactgtcgtctgccataaatcaatccggtattttagtgttagacacttcctcccggtacgcccggaaatctttcatgatctcttcgatctcctcgatgaaataaggatctttcaccttattcctcacctcctcataataggtctctatggcagccaacgcacatacgtcctgccctctcagcacgaagtaaggttcctccttctccacgcactgcttgatcatttgtataggattcttcattttttcttatttgctatatctaactcttctttcaagaacggagccgtaaacccgacaccactctccgctaaagcctccggagtccctgtgaaaaggacgttacctccacggcgaccgccctcggggcccatatcgatcaagtaatcggcgcttttgataacatcgaggttatgttcgataacgatgatcgtgttgcctttatccaccaacttgttcaatacccccagcaagacccggatatcctcgaagtgcagaccggtggtaggttcatccaatacataaagcgtctttcccgtatcccgcttcgccagctcggtagccagcttgacacgttggctctcgccaccggataaggtagtagagggttgccccaacttgatatatcccagccctacatcctgcaggaccttgatcttggataagatagtcgggatattctcgaagaactccactgccatattaatcgtcatatccaagatatccgcaattgatttcccacgaaaacgaacctctagggtttcccggttatatcgcttgccgtgacaatcctcgcaaggcaccagcacgtccggaaggaaattcatctcgatcgtcttatagccatttcccttacaggtctcgcaccgtccgcccgatacgttaaaagagaaacgtcccggtttataccctctcaccttcgattccggaagttccacgaacagattccggatatccgagaatacccccgtataggtagccgggttgctccggggggaacgaccgatcggagattgatccacattcacgatcttatcgacatgctcgattccctcgatggcgtcgtatgccaaggggtcttccagcgagcgatagaaatgctggctcaagatcggttgcagcgtgcggtttatcaaggtagactttccgctacccgacacacccgtgacgcaaataagagtacccaaggggaaagacacgtccacatgcttcaggttattgccgctggctcccttgatcgtaataaactgcccgttgcctttccgacgctcggcaggaacggctatctccgtgtttccattcagataggaagaggtcaaggtatctacacgcagcatctccttgggcgttccctcaaagacgacctcaccccccagacgacccgctttaggccccatatccaccacgtaatcggcactcagcatcatatccttatcatgctccacgacgatcacggagtttcccgtatcacgcaattgcttcaaggagttaatcagacggacgttgtcccgctggtgcaaaccgatactcggctcatccaatatataaagtacattcaccaattggcttccgatctgggtagccaaacggatacgctggctctcgccaccggacaaggtagcggaaccccggttcatggaaagataatccaatcccacatccagcaagaagcgcaggcgggagcgtatctccttcaatatctccgtagcgatccgaagctgtttcgggtccagcttctcctcgataccctccagccactcgtataattccgagatatccatggccgacaactcggcgatattctttcccgctatccggtagctcaacgcctccttatttaaccgccaaccgttacattccggacaagtggccatcttgatgaattgtcccgcccatttctgcgccgaggcggatgcctcgctctcctgttgcatcaagatatacttcgcgactccctcatacgacaagaaatagttagacgatcctaacgagtcattcttgatctgcaaccgctcgtccgtaccgttcatgatctcgtccatcgcctcctcgggaatatcccgtataggcgtcttgatcgtcacgccatgcttttggcaaagcgcctcgatctgccagaatatcaacgaattcttatatttacctaaagcgacgatgccaccgctatatatacttaaggatggatcgggaacgatcttgtccatatccaacaaattgacctgtcctaagcctttacatttcggacacgctccttgaggggagttgaacgagaaattatgcggagccggctcactgtaagacaatccggtcaccgggtccatcaagcgacgactataatggcgaacctcgttagtctcggcatccagtatcagcacaaggccatcgccttgcttcatggcgatcttcaagctctctttcaaacgacgctcgtctgcctcggagacaatcatcttatcgatcactacctcgatgctgtgcatcttataacgatccagcttcatcccatggaagatctctttcaactcgccatcgacacggacgttcagatatccttttttacgtatctgctcgaaaagttccttatagtgccccttacgattacggaccaacggagccaagagatacgtttttttcccgttgtactcatccaagatcagccgtaagacttgatcctcggtatatttcaccatcttctccccgctcaaataggaataggcctctcccgccctagcgtaaagcaaacggaaaaagtcatagatctcggtagtcgtaccgacggtggaacgaggattcttattggttgtcttttgctcaatggagataaccggactcagacccgttatcttatccacatcgggtctctccatattccctaagaaattccgggcgtaagccgagaatgtctccacataccgcctttgtccctcagcgaaaatcgtatcgaacgccaatgatgacttgccgctaccactcatgccggtaatcaccgtcaacttattcctcggaatctctacatctatattcttcagattatgaacacgtgcgccaagtatggatatgcgcccgccttccaatgcctgcttatcttttatcatcttttacctatctggttttaggggccgtaaagatacgaaaaaaacagaagccaatcaaactttccagcaaatcatagtgtaatctcagccacttcctccagcctgtttgttccctacgggaagacctcgcagtatccaccgtaaggaaccagggtttctatttatccttcacctctggctggggagaaggagcctgtatgttctcataaaacctctttttctcctcgttacttttttggacaaggcttgtcacatataccgtaaatattggaaacatcatcatgcccaaagcagccaatacgactgagaggactcgtcccgtaaccgtaatagcggatatgttagagccaaccgtcgtcacatccataaacgcccaccatagagcgtccccataattagccaccaacgggttcaccttatgctccaagacaaaaaatataagacttgagaaataaaccgtggccaacaacatcgtcaagtaagaaacaaacaagccggatgccttattatacgataaccatcccaccacgatcgccaacgcatacccgccccgtaccaaaggaacgaaacgtaagaaataactaagctcgggtgaggtgataatatgataatattctattatattttggtaagggatcgctacgagcaagaaaataaagtgcgttcgcaaataacgtaatttatctttcgataggaaaagttccaaaacaaaatcgaaaagaaaaaacaaacagatccataattgaatcttcttataagaagtttgcgtgtaaaagggaatattcttaaatgtatcgatggagatactgataaccaagaacagcgacaacaatagtataatgatatgtaacacaccatatacccccttctttctcaatgcgaaatcaaatacggccattttcataagcgttactatttatttaattataatccttttcattttggtttatgacaacaaacctcatataccatttgtttaaacagcgaaatgtgttaattaaccaagttttacgtagcaaaaacaaaacatcttctttgattcgctgttataaactcagacttaaacgagagaagtaattctcatttttaaaacataaatctatggcaaatatcaacaagacagtaaagctaggtgtgtttaccctagcaatcatgaacgtgacggcagtagtatctttacgcggactgccagcagaagccgtatacggactaagttcggctttctattacttattcgcggcaatcgtattcttaatcccgacctctttggtggcagcggaattagcggcaatgttccaagacaaacaaggtggtgtattccgttgggtaggtgaggcctatggaaaacgtctaggctttctggctatctgggttcaatggattgaaagtacgatctggtatccgacagtattaacttttggagccgtatccatcgccttcatcggtatggatcatcccgaagatatgctgctggcgaataacaaatactacacgttagcgatcgtgttaattatttattggctggctacatttatctcactaaagggattgagttgggttggaaaagtagcgaaaattggaggtatggtaggtactatcatcccggcggccttactcatcattttaggtatcgtatatctagcgactggcgggcattccaatatggatttccacagtaacttcttccccgacttcagtaaattcgacaacttagtcttagccgcaagtatcttccttttttacgcaggtatggaaatgggcggtattcacgtgaaagacgttgacaatccttctaaaaactatccgaaagctgtatttatcggtgccttgatcaccgttgtaatcttcgtactaggaacttttgcgttgggtattattatcccagagaaagacatcaatcttacgcaaagtttattagtgggattcgacaattacttcaagtacattcatgcctcatggttatctccaattatcgctatcgctttggcatttggcgtattagcaggagtattgacatgggtcgctggtccttccaaaggtatattcgcagttggtaaagcaggttatctgcccccgttcttccagaagaccaataagatcggcgtacagaaaaacatcctttatatccaaggagcggctgttacacttcttagcttattattcgtggtaatgccatccgtacaaagcttttatcagatcttatcacagcttacggtgatcttatatttaataatgtatatgttgatgttctccggagcgatcgcattacgttataagatgaaaaaggcaggtcgtcctttccgtatcggaaaaggtggcaatggcttgatgtggttgatcggaggtttaggattctgtggttccttattagcgttcgtattaagtttcattcctcctagccagatttctacaggaaataatacggtttggttcgccgttctcttcatcggtgtaatagttgtcgttgcggcaccgtttattatctatgcgtctaagaaagcatcttgggtagatccgaacactgaattcgaaccgttccattgggaagtaaaaaatgacgtatccgagacgaatacgacaaaagcataacacacattcatctcgataattacctagtccgggctgcgaaaatattgcagctcggactttttcgtaaaaatagcacagaatatttacgttttattatgtgtattataaaaatgtaattatctttgcgatagtattcataaaataaaatatcaaaagaactatggcacgtacagtagattattcaaaaaaggcagagaaaatcaaagagcaagtagatgaattagtacaagaattaatggctgctaaatcggctccggtagtctccaaaagaagtttaaaagtagctgacatcaatttcgagaacgaggatgttaatacattaatgcaaatacaagctcgcctcgctcgcgttatcttggagaagagcaaataagaaaaaactctgctaaggttttaataaaagcgcctttcccgtctttaaggatgtttcgggaaaggcactttatttttcaggtctcgtgcgaactttcaaagaaaaagcttatctttgaaaacctaatcaataacatgtatggaactaacactcccaacgaaagttaatgtgacacatcccatcatgctagacacgaagatattagtcgtgatcggagcgaacggtgcggggaaaagctcttttggcagagatttattggagagatatgcgggtcaagcgaaaagaatatccggtatacatgccttattcatcagcgatgacgaatctaaattatcggcttccaatgaattcgcacgtttacagtctatgatcaaagaacgactgttcatgccacgtatttctgaatacgagaaactgattttgcaactccagagcgaggagttcgaggcggcagtcaatttcaaggaagccagcaaaactaataacaaagtagatcctccgatcaccaagatagatattatacaagcgatctgggaaaagatgtttccgcataatcgcctgatacgaaagtcgggatttatcgagcttgtatccacggggcgtgattcaaattcctacaccgccggacgcatgagcgatagcgagaaactggtgttctacttgattggggccgcattatgcgcatgcccgaacgccttgctcgtgatcgaagagccggaaacccttctccacaactccataaagaaccagctttgggacgagattgaggcgatacgcccggactgtacgtttgtttatctcacacatgacattgatttcgccacctcccgctccgacagcaaacggatctggattcgttcttacgacgcagatcattccgtatgggattacgagttgatcgagagtaatgaaagttttccagaagaagtatatatggaaatacttggcagccggaaaccgatcttgtttatcgaagggaccgacacgaacagtatcgacagtaagctttaccccttcatattccccgattatttggtgaaaccgatgggtggttgccaaaaagtaatcgagacaaccaaagcgttcggccaactgaaagacttccatacattagatagcaaaggtatcgtagatcgtgacaggcgtacgcaaggagaaataaactatctacgggaacaacatatttatgtaccggacgtagcggaagtggagaacctattgatgatagaggatgtgatcaagacggtcgccaaacggttgatgaaagatccggacgatgttttcaagcaagtgaaagaaaacgtagtacgtcttttccaaaaagaactggactcgcaagtaatccttcatgccaaacatcaagtccgtaaaaaactggagactaccgttgatcgcaagataacgacggtggagcaattaaccgaacatgtagagagtatccgtctgaacatccatgcggaagaaatatacaaaaacataaaagaagaattcgagttttatatagaaacggagaactacaaaagcatcctccgtgtttataatcaaaaaggtatgttaccacagagccgcctatgcgcgatctgcggtatcagtaacaaagagagttatttaaacctgattctctccatattaaaggaaaacaaggaggatgcggaagcgatacgaaaggctatcaaacattcattgggcacataaaaagtttctaaaaatgcggggaaagtccataaaaaattgttcttttgcaaactgttttataacattaatgggccaaagccctatatattaattgtcatatgcgtacacctacacttcaatatctttacttgcaaaagccggtaaccatgatggtagtaatctgtattatatctgtgttaccttggattggcctcggcgacttttccaccaaaggggaacctcgggaagcggccgtagcgatctccatgctcgagacaggtaattgggtcttgccacaatcttacgcgaacgagttcgcttttaagccaccgatggcgcattggttaatggctgctttctcctatccacagggatatgtttccgagttcacttcccgcttgccatcggctttagcctttattaccttgatcgggttcgtattggtctttttcggtaaacgaatcgtaaagtttcaggaggcattcatagcgaccctcctattggtcacctgcgtagagatacatcgggcggccatgacgactcgggtggatatgttgctcactactttcatcgtcatagggcttttccagctatatcgatgggaagataaattagagctgaaaggacttcccatattcatacctttattattaggatgcgccgttctgaccaaaggaccggtaggcgtagtattgcccctattcgtattcggcatttatctattaatgttaggtcaatacagttatctcaccatattcaagactttattatatgcgggaatttcctctttattcctaccgatgttgtggtataccgctgcatggaagcagggtggagatgagttccttaatgtcgtattagcggagaatttcgctcgtttcttacacctaaacactcctgaaatttcctatgatctggggcatgagaatggtgtttggtacaatttcatgacgttggcggcaggctttataccttggactattttctttttcttctctttattcgggctgaaacttagcaagcctgagcaatctattaaagagatcttaaagaatacgtggaaacgtatccgctccatggaaaaagttcgtttatttagtttggttgctttagtctgcatccttttcttctattcgataccttccagtaaacgaagcgtatatttaatgccggcttatccgttcattgccttgttcttggctcagtatgccttatatattacagaataccgtacgaaagtaactcgggtattcgctgcctttttagcttccgtagtaagtgtcgtcatgatagcgatcttgcttacggtattcagtattattgatcctgttggtatcgtcggtcaatatacacaaaacgcatcgaccttggacatggtacaaatggtatcaaaagtattagttcaccccagtacgcttacgatctgtattatcttcataaatctattgatattaggaacggtctattaccagatgttcaagaaaataaatatcaagatcctctacgctacgatagccttgacattctcggttaatttattaattgatggtgtcattatgagaggtattcgtgaaggggattcttgccgtgttttcgctgaacgtatcctgaaagaatatccattgaataaaaagaatgtatatgtcgtaaataaccttcggatttatcggaatctgtacggattaaacttctatatgggaaatatcttccatgacttcgataaagaaacacccgccaaaggttatttcctgatcggagaaaatgagatggaaaaggtactttccgcatacggggataaatataccttccgtacactgactaagtcagatcaaacgttcagcgagctaaaacaaaaaatcgtgcttagcgagttcgagttgaaatagaaatgtaatatctaatagtataccatgaatagttcctatatttcccctttcgccaagccggtctacatcatgttgaaaccggttggttctgtttgtaatttggcatgcgagtattgttattaccttgagaaaagtaagttctatccgaacgtgaagaatcacatcatgacggatcagatactcgagaagttcatcaaggaatacatggaatgccagaccatgcaagaagtcttgtttacatggcatggaggcgagacgctgatgcggccgatcagcttctataaaaaagccttggagttgcagcgtaaatatgcgggaggacggcaaatagacaactgtatccaaaccaatggtaccctattgaatgatgagtggtgccaatttttcaaggaaaataatttcttggtgggtgtatctatcgatggcccgcaagagttccacgacgaataccgtaggaaccggcagggactcccctctttctataaggtgatgaagggaatcgagttgctgaaaaaacatggggtagaatataacgccatggccgtcgtgaatgattataacgtggattatccgctggaattctataatttcttcaaggaactggattgccgtttcatccaattcgccccgatcgtggagcgtatcggccggcacaaggaaggtaccaagttatcttctcccgaggagcaagacgcagcgatcgagctagctccgttctcggtagatagcgagaaatggggggatttcctttgcgccttgttcgacgagtggctgaaagaggatgtcggcaagttctacatccaattattcgattccaccttggccaactgggtaggcgagcaacccggagtctgctccttggcccgccattgcggtcacgccggggtaatggagttcaatggcgacgtgtacgcttgcgaccatttcgtattcccggaatacaaactcgggaatatccaaacaaagacattaacggagatgatgtacagtccggtacaacaaaagtttggaacggataaagaagataagctccctacgcaatgcaaggaatgcgaatatcttttcgcttgtcatggggaatgcccgaaaaaccggttcctccatacgccgaatggagagccgggactaaattatctatgtaagggatacaagaaattcttcaagcacgtagctccttacatggattttatgaaaaaagagttattgaatcaacgtccacccgcaaacgtgatggattgggctaaacaacaacaacatgaatattaacagacgtgatttcattaaaacaggaagtatggttatgcttggaacattagcggctccttccctactaggaagttgcaccggtagtgagagtgataaagcagccggtatttcattcgccatgaattatttcaaggtgagtgagggggatttgaggaaagtattggcggcagccttggagaaaggcggggattatgccgatttgttttttgagcattcatacaggaacaacgtagggttgcaggatggtgccgtaaaccgtgcctcatctaacatcgattttgggatgggcgtacgtgttttgtccggcgaccaaacgggatatgcctacgtggagaacgtcagcttggacgagatgctaaaggcggctcgtacggccgcgcggatcgccacaggatcggcgaataccgctcctatcaacttaacggaagaaaagcatacgaacaatttctatagcgtacaaacaccttgggacgagatagccattaatgacaagatgcctttcttgcagaaactgaacgatcagatcttcgccaaggacaagcgggtcaccaaggtgatggcctctttgggagacacgacctctcatatcttattttgtaactcggaagggcagatttattacgattatcgcccgatgagcgccttgagcgccgtctgcatcatggaggataacgggaagatcgagaactcgtacgccgcacgggcttttcgtatgggagcggaattcctgacggacgacctgatcgacgagcttgcccaagaggcggtggataagacctctatcttatttcaggcgatcaagcctaaaggcggggaaatgcccgttgtcatgggtgccggtggctctggcatcttattgcacgaggcgatcggccatgctttcgaggcagatttcaaccgtaagaacacctctattttctctgatcaactgaacaagaaagtttgcaacgagcatatcaacgtggtggacgacggcacgattcctttcaaccggggctcggtcaatatcgatgacgagggtgtggacggacaaaaaacctatatcgtacgggagggagtcttgaccagttatctgcacgatcgtatcagcgcgaaacattacggcatcccctctacgggcaatggccgccgggagtctttccgtcagatgcctatcccccgtatgcgtgccacttatatggaagcgggcaacgtgacggaagaggagatcatctctaccgtaaagaaaggtatctatgccgccaacttcacgaacgggcaggtacagatcggcgcgggcgattttaccttcttcgtgaaggatggttacttgatcgagaacggcaagctcacccaacctatcaaggatatcaatatcatcggtaacggcccgaaagcgttggcggatatcacgatggtgggtaataattataaaatggataacggcacatggacctgcggtaaggatggacagtcttgcccggtaacctgcggtatgccgtcggccttagtcagcaaacttacagtaggaggagaaaactaatatgataacaaacgaaaataagaaattggctcaatgggccatggaatatgccttgaagaatggttgccaatcttcacgtgtcacgctttacaatggttccagcagttcgtttgagatacgggatatgaaaatagaccgtctgcaacaggcatccgagaacagcatggtggttcatttgttcgtggacggccgttacggctcctactctaccaatcgcttggataagaaagagctggagaagttcatcaaggatggtatcgccgccactcgtttcctcgccgaggacaaggctcgcacgctgccggacgcttccttgtattataaaggtggggcggcggacttgcgattggtcgacccgaatttcgactccgtgcaaccggacgacaaggtagcgttggccatgagcgtctgtgaggagatcatgggcaaggacgaccggatcatctccgccaacgcttcctacagcgacgagaaggactttaagtacatggtagccagcaacggtttcgaaggcgaggcttctggttcctcttatggcttggtggggagtgtcagcatccgtggggagggtgacgcccgtcccgagtcttattggtacgactcttccttgtattatgacgagctggtgaagaccggtatcggtacgaaagcactggaacgggtgcttcgaaaactgggacagcggaaagtggcgtccggtaaatataccatgatcgtggataacatgaactccagtcgtctgctttctccagtaatcggagccatttacggttcctccatccagcaaaagaactctttcttgttggataagatcgaccaaaaggtagcgagcgacaagatgaccttgatagatgagcctcatttggtaaaggcttccggcgcacgttatttcgatagcgagggtgttgccacgaaacgtcttccggtattcgagcagggtatattgaaaacgtattatatcgatacgtattccgccaacaagatggacatggaacaaacgatcggctctccctcgattcttaccatgcggaatggtgataaggatctggacggattgatcgcctctatcgacaaaggtatattggtgaccggcttcaacggtggaaactgcaatagcacgaccggcgatttctcgtatggcgtggaaggtttcttgatcgagagaggcaagctatcccaaccgatctccgagatgaacgccacgggtaatatgctctccctatggagtaacctagcggaagtcggaaacgacccccgcctatcctccagctggcgaatcccttccttgcttttcaatggggttgattttagcggattataaatacgagaaacaacatacggaagaacaagaataaaagaagccggaaccgctaaacacagttccggcttctttgtttttccttacaccaaattatagatcgctataaaatggcaaactgttcccccgagaacgaataaatgccatgcggaatgcatatatttatatttatccagaaagaagaaaatcgttcctaaggaatagaacaagcctcctccgatcagccaatataagacatacatcgaatccgtacgctggaaaacatcgatcaaaggtttgaaagcgataatcaccacccaactcatcagcagataacaaaccgttttcagattatcctttttcttcatccgacggaaactaaaccatacgccgataactgcggccagccaaaccgtaataaataatccccagccccagaaaccctcgtcgcggagagccaccaaggtaaatggcgtataagtacctgcgatatgcaaataaatagcgctatgatcccaacggcgcaactggcattttcgcttgggatcggaagcggcgtggtaaaaggtagaggtcacatacgaggaagtcatgcacaacgcataaacggcgaaactaccgatcacccacggatcacctgtacgaatcccggcgatcatcaaaacgataatcgctgttaagccgaacaacatgcccgcgccatgcgtaagcacattcgctacttcctcaccatgagtctgtctttgttttctcatccatccgatcgctacgactacaaggcgctagccttgaaaccggcctccgatacggctgaaagaatggtctccgccggaagatcggttgttatagtcaatgttttatccggggatttcaagtcgatcgaccatgcgtcctcttttactaatttattcaacttagtgccgatagccgccacgcatccgccacatttagcgtttgtcttaaattttaatgttgccatatctctatttgttatttaaagtttactccatttcaaccgtaagctgtttaataccaccgacacggaactgaaagccatcgcggcgctcgccaacatcgggttcagtaacagtccgttcaccgggaataagacacccgccgccaatgggattccgatcaagttatagataaatgcccagaataaattctgatggatcgagcgaaccgtacgtttcgacaggcggatcgcatccggcaataacatcaaatccgaggtaatcaacgtgaccatcgccacatccatggcgatatccgttcccttacccatcgcaatgctcacatccgcacgggccaaggcttgcgagtcgttgataccatcccccaccatagccactttccttccggcggcttgcaaggaacggatatactcctccttatcgctcggcaagacatctgccttataatgacggatatccagcatggccgcaacggtctcggcggtccgttttccatcgccggtcaataaatgaacctcgatacccatttctttcaaggcctctaccgcctctcccgacgtaggtttcaaccgatccgaaatagccatgaccgcaagcaattccgattcccaaccgtaataaacgatactcttgccatcctcttcccaccggatgatttcccgcccagcctcgggcggaaccatcgccttgaaggtttccaaaaagcctttgcttcctacccaatacgtcacgccatgtacctgcatttggataccacgccccgttacgctctcgaaactatcagcgtcgatctccgtggcctccgttcctttcaaccatgagaggatagcggacgccaaaggatgctcagacttcatctcggcggtataaaggatatccagcatatcccggctcgcctccgatacccagaaagagtcggtcacctcgggcacgccctcggtcaaggtcccggtcttatccagcacgacggtatccaccttacaaaggttttccaaggcaaaagcgtctttgatcaatatatgatgctcggcgcctttacccatcccgaccatcaaggcagttggcgtagcaagtcccaacgcgcaagggcaagcgatcaccaataccgataccgccgataagagagcgtacgagaagtacccgcttcctcctactaccagccagacgataaaagtaagtatcgccaatccgacaacgatcggtacaaatataccacttattttatcaacgatacgctgcacgggcgccttacttccttgggcggcttgtaccatctgtacgatttgcgataatacggtagcgctccccaccccggtcgcctccatcaagaaagcgcccttttggttgatcgtcccggccaagacccggtcgccttgtgatttcacgacagggatcggctcgccactcaacatgctctcatccacggaagaggaaccttgagacaccgtgccgtccaccgggatcttctcaccgggacggacactgacaagatctcccacccgcaagaacgagatagagacctcttcctcctgaccatctcgcacacgacgggcggttttaggctgtaatcccatcaagctcttgatagcggaagaagtgctgttcttcgcccgctcctccagaagtttacccaacagaacgaacgctatgatcacgccggatgcctcataataaacatgcggctccaatcctttctcataccagaaccgcggatatacggtattgaagaaactgaacaggaaagcgatcgaggtactcaacgccaccaatgtatccatattggcgctaccgtgcaacgcatggcgcacgccgttcacgtagaacgaccgcccgaacacgatcataatcaccaaggccagcgccatcatgatccagttaccgccgggcgtatgcataaacaccattcccagcagggccagcggaatggaaagtacccacgccccgatcgtattccggcgtagcttccgataatgctctcgtgccatctcttcctgtaccgccgtcggatcctctacctccacgaccaaatcgtatccggcctcctgcacggcctctctcattttctgaggagtaatcaaggatggatggtatttgacggaaagcgtattcgccgcgaaattcaccgatgcctcctccacgccgggaagtcccttcaccgtattctctacgttattggcacatacggcacaactcatctcgagaaccggtagtataattgtctccaaatctttcatagatcgtatcacctgtttagttatatataaatgaataacaaagatacgataaatatgattgcaaccagattgcaaactttacgaaacagtatttacgtacgttaagaaacctaggaacttaatagatttatttgagaaatatgactattatttaacagggaaatacccgacatttgtaacgattttcaaaccaattactaaaacttaataacaatatgattctagactcacttgagaactctaagcggatcgaatgtatccatccgctgtttaagcaggcttttgactatgttaagtctactgatttttcaaaaatggaagatggtaaatacgatatagcggacgctggtttcacggttagcatcgccagcctcttcggaaaggagaagtcggaagcggccatcgagacccacaagaaatttatcgatatccaattccccttattgggcgtagagaaaatcggatggaaaccgggagatcaattactagaggagtccgttccatacaacgaggagcaagatatcgccttttatatcgacaaacctaccgcctatacgaaaatctatcccggacaattcgccatttatttcccggaagacgggcacgccccgggtatcggccaagggaatatccggaaggtggttatcaagatcccggtccaatagtatcgaataccctatctgttccgcaagaataatcagctgaatacttatatattctatatcggatctacttctattctacaaaccacggcgtggtctttgtaaaccacgccatgatctgtaaagaccacgccgtggtttataggattcacgacgagaatcaaggaatagatacagatacgattatctttattcataagaagatttccctattcaaccgtatattcgcatatatgcgtttgtaatactttattcacctcaaatccacttaaatctcgtaaattcttgttacctttgatgcccggtacaaaataaaagtaatacaaaggaagatgatttcagaagaattgaagaacgacctaaagataaaatgggatcggatgagagatggtatggcaaagatgggtatggatgcctgtttgcttaccgtagatgtaaatctttattatacgacaggacaaatctatagtggttatttttatttgccggtagacggtgagccgtggttcttgatcaagcgaccgaacgggctttcaggacatcaagtggaatacatccgtaagccggaagacatcccacccttatttgcggaacgagggattaagatgcccaaaaagctcttgttagaggcagatgagttaacttataatgaatacatccgtttagataaggtattccaaccggaggaggccggtaacgccaccgctttcatgcgaaaccttcgccgggtaaaaaccccttgggagatcgggcaattccgtatcgccgcccgcaagcacgaggctacttatagcgagatcccggaatgtttccgtcccggtatgacagacttggagttccagtacgagatcgagaaacgtatgcgcaagaacggctcgatcggtcttttccgtgctttcggagccaatatggatatctatatgggtagtattctcgccggggaaaacgccgagaccccatccccttttgatttcgctttgggtggaggcggcatagacgcttcttgtccgctaggcgctaacggtactttattaaaagaaggtaccgctatcatggtggatatggccggcaattatacggcttatatgacggacatgacccgtgtcttctccgtagggcgcctgacggaggaagcttatcgggcgcatcaagtggcccttacgatacagcaggaggtagaaaacgctacccgcccgggaaccgcttgttcggatttatataatatagcggcgaatatcgctaagaaagaaggtctttcggctaactttatgggaaccgagcagcaggctaaattcgtgggacatggcatcggtatacagatcaatgagctacccgtgcttacccctcgctcgaaagaggagcttttgccgaatatggtattcgccttggagcccaaattcgtgatcccgggtgtcggtgccgtgggtatcgagaacagtttccttgtaacggagacgggcgtggagaagttgacacggttcaacgaggagatcatcccacttggaaattaagatttaatagaagaatttgttatacattattaaattaaagcacatgaaaaaaacattagcttttctacttttgctggctattatcattatgccggccaatgccgtggaaaaggagaacgtgaagcctgtcaagaacgtgattctcttaatcccggacggaacctcattggcgactatctctatcgcccgttggttgcaatggtaccaagatcccagcaaaccgaaattgaacatcgacccgtatttgtgcggaacggtgcgtacgcattcttctaacgcccctatcggcgactccgctcctactacatcatgctacatgaccggacagccgagccgtacgggttatgtatccacttacccggagaacgacggtgataacgatatctacccgaccgatccggcccgtgctttccaaccgcttaccaccgtattggaggctggaaagatgttgcagggcaaagccacgggattggttttcacttgcgaattcccgcacgctaccccggcggactgctccgctcatagctacaatcgtggtaaatacgactggatcgctccgcagatggttcataatgatatcaatgtcgttatcggtggcggagtgtctatccttacaaaggatatggaagattatctattggcgaacggatacggcgtatatagaaacgacctgaaaggtatgcgtgccgataataatcagaagatgtgggctttatatggcaacaaggaaatggcttacgatatcgaccgcaatccggaagagcaaccttctatcgaggaaatgactcgtaaggcgatcgacaaattatccaagaacccgaatggcttcttcttgatggtagaaggcagtaaggtagactgggccgctcatggaaatgacccggtaggtatggctaccgatttcttggcattcgatcgtgcctgcggtgccgcattggagttcgcacgcaataatggcgagactgccgttgtcatcgtacccgaccacggaaacagcggtatcagcttaggtagaagagattgtaaaggttacgataaattgacgaaagaccaattgttccaccaattctccctgtataaattgacagccgagggtttcgccaacaaggtaaacagcgttcctaactcagaagtgcaaaatgtattccgcacctacgccggcttcgagctgactccggaagagatgaacgcgttgaacaattgcaaggattataagaatagcccgataccggaagaccaacgcaaaccggaagataattcctccatgtacagtggctcgttaaccggattgatggcgcatatcatcacttcccgcacttgcttcggtttcacgactggcggccatacgggcgaggaagtattcctagccgcttaccatccgcaaggaaccttacccctaggtatgaatacgaacatcgagctgaatgagtacttatgcaatttgttcggattgacacacgaaaacttggaagatcttacaaacaagaacttcgcacgccacacggacgtattcgaggattacacttgcgagatcgtccctgccgccgacgagaaaggttctccaaccttgatcgttaagaacaagaaagataagaaaaaacagctaacgatcaccccgttctccaatatcgtgaagtccgggaagaaaggccaagatgagatacggttaaactctgtcgtcgtttatgtcgataaaaataacacgttctatcttccggcaagtctagttgatttcttaaaataaaatataaagcggaggcccttcggtctccgctttttttatacattcgcgtacataagacagaatatacacaacctatgaaaagtaaaagtttagtttctatcgatcaatgttccaaagaggacattcttcgtattctggataacgcaaggaagtttgaggagaatccgaaccggaaattactggaaggcaaagtcgccgccaccctgttcttcgagccctctacacgtacgagactgagtttcgagacagccgtaaaccgtttaggtggacgggtgatcggtttctcggacgcttccacgactagttcctccaagggcgagaccttgaaagatacgatcttgatggtaagcaattacgtggacttgatcattatgagacatcatctggaaggagccgcccgctatgcttccgaggtgacggatgtccctatcatcaacgctggtgacggggcgaaccaacatccctcgcaaaccatgctggacctgtattccatccgcaagacacaaggcaagctggataacctcaccatcacgatggtcggcgatttgaagtatggccgtacggttcactccttgatcgtgggaatgtctcacttccatccgaccttccacttcgtcgcgccgaacgagctgcgcatgccggacgagcaaaagaacttctgcgacaagcacggactcaaatacgaggagcataccgatttcacggaagatatcatcaaccagacggatatcctttatatgacccgtgtacaacgtgagcgtttcacagacttggaagagtacgagcgggtaaagaacgtgtatatcctgcgtaacgacatgctgagaaacagccgtgagaacctgcgtatcttacatccgctaccccgtgtgaacgagatcgcttacgatgtagatgacaatccaaaggcttattacatccagcaggcacgcaacgggctgttcgcacgccaagctatcatttgcgaagttttaggtatatctatcgacgaataaaaacgaagttttatgtcagcagaaaagaaaaaagagttgcaggtagccgctttagagaacggtaccgccatagaccatattcctcccagccaattgttcaaggtagcctctttattgggactggagaaaatgaacaatacgattacgatcggaaataatttccccagcaataagatgggatgcaaaggcatgatcaagatcgccgacaagtttttcgaggaggacgagatcaaccgtatcgccatgatcgccccaaatgttatcttgaacattatccgtgattatgaggttgtagagaagaagacggttactttacccaatgagctgattggcttggttaaatgtaacaatccgaaatgtatcaccaataatgaaccgatgctttcccgcttccacgtgatcgacaaggagaagggaaccattaaatgtcattattgcgaacgtaagattaataaagaagacattatcattaaataattgaaagttgagaattgagaattgaaagtcaaagacctttgtggagctaattctcaattctcaactcgcaattgtaaaaactgcattttatatgaagcacgattggaaaccgggaaccatgatctatccattgccagccgtaatggtgagttgtgggaatgagccttccgagtacaatataataacagtcgcatgggtcggtacgatttgtacgaatccggcgatgtgctatatatccgtacgtccggaacgattctcttatccgatcttgaagaagaatatggaattcgtcatcaacttgacgaatcgtgagctggcctacgccacggattggtgcggggtaaactcagggaaagaccatcataaattcgaagagatgaagctcactcccggaaaagcgaccgtcgttaacgcccctacgatagacgagtctccgctttgtatcgaatgccgggtaaaagaggtaatcgctctcggaagtcatgatatgtttatcgctgatgtcgtaaacgtacaggccgacgaccgatatctagacccagagacaggggcttttgatatgcagaaagcggatcttttggcttactcgcatggtaagtattacgggttaggtgaatttgtcggtaaattcggctggtccgtgaaaaagaaaaaataacggtatgaaaaaagtctaccttataggagcgttgctatctttcggtctgttagcagaagcccagagcttcatgcgtttcgaggacaaggcattcaactttggagccaaagtaggattcaacgccactttcccagtcataaactccctttccatcaatgggaaggaagcggagaatatagacatcgaatataaggtaggttatctggccgcggtcttttgccgggtcaatatcgaacggttcttcctccagcctagtttctcatggtatcgctccgagggaaatatccgtttttccatacctcaaagtttgccggaaaataatatgatgtccaatacatcggcaactaccgacctcttgatgatgaaaaccagttccttagaggttcccataatggtaggctataacctagtgaagaaagggccttacggacttagccttatggtcggccccaaattaaaatacaactataagatcgcctatacggtagagtcttccaccacgcacgtagaatacgtgaatgacaacaccccgttcggagtcaatatcgctacgggtgtaggggttagcatcggacggctattcttcgactttgtctatgagttcggattgaatcaagtggaatccgatttcgagaaagtcaacaacccggttcccgagattaattatgatatcaatattgacaagcgaacgaacgtgatgagtatctcactcggcgtactcttctaaaaagacattttacccatttttcaagtacttgaccaaaaccttatcgatccgggcgccatccatatctacgatctcgaactcaaagtccagccactttaatttctcacccgtcttcggtacacgctccaatatctctaggatcaagccgctcaaggtattataatcatgctcagcatacaaatcctccatgtcgaaatattccaagaaatcatagaaagaatattggccgtccaccaaccaagtaccatcctcacgttgtatgatctcggactcctctccaacttccggtacttgcccgattaagccttccatgatatccttcaaggttacgataccttgaatgcctccgaactcatccgtaacgagtccatatttcacgtgtgtctgcttgaaagattccaaggcattatatacgctctggttctcgggaacgaactgtgccgggcgaagtacttggttgatcgagaaatccggttgatcgatccttccgaacaaatctttcagataaacgactcctactatattatcgaacttctctgaagccacgggatatatattaaataagttctcctccactttctcccgaatcttctccgtactatccgtcacatccagccaaaccagctcgctacgatgcgtcatgatagaacccacgttacggtctcccagattaaagacccgctctacgatgtcctgctctacctcttgcacctcgccaccgtcgaagccctctttcacgatcgccttgatttcttcctctgttaccctattttcctctttcgtatccacgcccgtcatcttcacagccaacgccgtactctttgaaagtagccaaacaaaaggagaggatatcaaggaaagaaaattcatgggtttagcaactaacatagagaccttctcggcacaccccatgccgatccgcttcggtaccaactctccgaatataagtgtaagatacgtcacgataataacgatcgtcgttttagcgatccccaacgcatacggttctagggccggtatttgcgctattataacagcgaaattatgagctaacgcctcgccagagtacaaaccggtcaagataccgatcaaggtaattccgatctggatggttgagagaaacttatccggctcatttgccagcttcaaagcagtgcccgcagatttattaccacgtttcgcttcggtttccaacctagccttccgggctgagaccaaggcgatttccgacatcgcaagaattccattcagtaagataaggccaataataatgactatttccattaattaatttatagtttgattatgctgcgaagatatataaatactttaatatataaaacaagacacctaagtgtctgcgcttacatttaactaaaaaaccttacgaatcccttgcggtttcaaaagaaaggcgtacttttgcatgacaaatacaaagtgtgattagaaatgctcgataaaattaaggctctgcttcaagaagtagagaatatgaaagcggcaaatgccgaggaactagaagctttacgtataaagtatctcagcaaaaaaggcgagatatcggcgttgatgaatgatttccgtaatgtagcggctgatcaaaaacgtgaggttggtaaatacttgaacgaactgaaggaaacaacccagagcaagatcaacgaattaaaagaaagctttgagaatgtacagaccgcaaacgatgatatcgatttgactcgtacggcttacccgatcgaactaggcactcgtcatcctctatcacttgtaaagaaagaaatttgcgatatattcggacggttaggattcagcatcgctgagggaccggaaatcgaggacgactggcatgtcttctcttccttgaatttcgccgaggaccatcctgcccgcgatatgcaagacacgttctttatccagcataacccggatgtattgcttcgcacacatacttcttccgtacagacccgagtaatggaaaagcaagaaccgcctatccgtatcatctgtccgggacgtgtatatcgtaatgaggctatctcctatcgtgctcactgtttcttccatcaagtagaagcgttatatgtagataagaacgtctcattcgccgacttgaaacaagccttgttgttcttcgccaaggaaatgttcagtccggatacaaaaattcgcttgcgtccttcttacttcccgttcacggagccatccgccgagatggacatctcctgcaacatttgtggaggtaagggttgccccttctgtaaaggaaccggttgggtagagatcctcggttgcggtatggtagacccgaacgtgcttgagaactgcggtatcgatagcaaggtttattcaggctacgcgttgggaatgggtatcgagcgtattaccaatttgaaataccaagtaaaagacttacgcatgttctcggaaaacgatgttcgtttcttgagacagtttgagtcggccaattaaattgaaaacctaaatcatttaccatctccccgggccttaacctagcccgggggaaacacactaggttaattatgataaaggtttttcttttaataataggaggagctatcggatctgcgctacggttcggagtttccacgtgggtgcaacgatcgatgctttactcctttccttttggtatcttgtcggtcaatgtgatcggctcctttttaatcggcttctgctggagtatagcggaagcctataatttttctatcaatacaagagctttcctattcactggtcttttcggtggtttcacgactttctcttctttcgctctcgacacgatggtacttatgcgtaccggagaatacaagatggcactactcaatgtacttgccagtaatatccttggtttgatagcggtcttccttgggatcatacttgggaagaatatcattgcaatgatcaagtaaataaataaaaaaacacggcacaagtcagtcatgacaaggccgtgttatatcgaataaagctgtttccaaattatctatttactaacctcaagaatactttcttagaaaaataagaaggtaaaaacagaataaagaaatacagatacgaagccatcggggaatatccgagaaccgttctataaacacgtaaattatactttatgagagaccatttattccgagagatagaacttgagtgaattcggtaaatcgccaatggctctttcaagccgtaagcgacctcacaacgcctaagtatggtaagccataacccccaatcttgccgtttacgtaattccggcataaagacctttcccactttctccgtatcatagacagcggtcaagcagccaatcccatcatcacaccgcatagagaaataggtctcccttctttttccgataacaatgctggaaatcttgctactctcgtcgcaagtcatatacgaggtataagataaggcacaatccttctctcgcataaaagccaactgtttctccagcttttccgggcaccatcgatcatcactatcgcaaaaagcgataaatcgtcctttggcctccgagatagagcgattcctacaaacacccgccccacaattcttttctaaccggaacaacttaatacgggaatccttttgaatataccgctctatgatctcaacagaacgatccgtagagcaatcgtcagtaatcaacagttcccaattaagataagtctgcgaaagaatcgactcaatggttcccgctataaaagacgaagaattataagaaggagtaataatggagaccaaaccgaaattatccataactattttccgatacattcataggtaaagcctagctcacccaattccttcgcatcatagatattgcgaccatccagcagcaaaggttgcctcatcactttcttgatcacggcccaacttggcaagcgaaactgtttccactcggtcaacaacaacaatgcgtctgcatcgattaccgcctcatacatatccttcgcgtaaacaacccgatcagcaactctacgtttgcactcgcctatcgccacaggatcaaacaccttgaccacggcacccgctttccgtaaaagatcaatcatcaccaaagaggtagcctcacgcatatcatccgtctccggcttgaaagacaagccccagagagcgatcgttctcccctccaaagagtcaaaatgttttctaagcttcgtataaaggatcgtcttctgacgttcattcacctcctccacggcctttagcactcccatcggataaccattcttttccgccgtcttgataagagccttcacgtctttagggaaacaactacctccatagccacatcccggatacaggaatttattaccgattcgactgtccgaaccgatccccttccggaccatattcacgtcagcgccaaccaactcgcaaagattcgctatatcattcatgaacgagatacgagtagccaacatggaatttgccgcatacttaatcatctccgccgagggaatatccgtaaagatcacccggaaattattcaggagaaacggacgatagagcttgctcatcatctccttcgccctctccgactccacaccgaccactacccggtccggactcatgaaatccttgatggccgcaccctccttcaagaactccggattcgaggccacatcaaaggggatatccatcccacgtttactcaactcctcttgaatcgcagcctttaccttccgtgccgtacccacgggaaccgtactcttggttaccaataccgtatatttcttaatatattggccaaacgtacgagcgacctccaacacataacgcaggtcggcgctaccatcctcgtccggtggcgtacccacggcgctaaaaacgatatccacgttatccagacaagaggccagatccgtcgtaaaatgaagtctgccttccttggaattacgcaataccatctcttccaaccccggctcataaatcgggatattcccctccaacaagccatttattttctcccggttgacatccacgcaagtgacatcaacccccatctcggcaaaacaagtcccggacaccaggcctacgtagccggtgccgataattgcgatattcataagttataagattatatatttcaggaaatctatagagaagtcaagttttggtatacgtatattacgcataccaagccaaatgatatgcgatattcaattttttaaactatttacggcaaagaagacaaggatagcctcatgcttttccctctatcaacgaaagcaaggtattcaaataattatcaacagaatccatcaagggaagaatctcattggcatcgatcacaatccaatcatcataatccccactttgtctcaactcaaatagtttactataaaaacgtcccaagtctttactgattattcctgtacttacaaaatgaagacctaataaacgaatcactcctgaatgcgtagaagcctgaaagccatttttaattaacagtgccgtggtcatataataacaagcaaatacattctattagcggccgcatgccaataaccacactctacgatccctttggtttcctcccaagtatcaaaagctctagcctttcttgctataacaagggcttcccgttcttcatctgttagattcatagttctataccatctaattccacattcttgaaaaaaggagtacctttacgtttcatccattcagtaaaggtatataacttagtgctaaaatattcgccaaattgccatcctaggtcgattaaaggataggcataggtatcaaaatccgcagaggttatcttttccttgtccaacaatattagaatatcccaatccgattcatcatggacatctccacgggcttgcgaaccaaacaaaaaaacctttgttccagctggcatcacttgctttatcaaagccctaagagaatataatatatcgtccttcctcattgttgtacaaaataaacatattatcatacgatcgatcatattgatttacagccatcgcacgatagttaccaccacaaatatacttacttttagctaggccacaaatattcttcttgatttttatcgtataagacaccttgcctacatagccggtaccgacaatggcattatatacaacccccgttttccagtacgaggcgaatcaaagcataggtactttccagaaggggatactctgggatgtaaatcgcaagctatatggcatttaaaatctttcgtttgaaactctttgggagaatagatacttagcaacaaatccgcactttgagtattgatatcagccttatagatttttgccatcctatatttatccggataagtatccgccacaaaagacgtatccgagataaaggactgatgaccatccgaattcaacacatcccctgctattatttgataatgagctacatctttcatgtcatacaatacatgacaactgttaccatttataatgcaagacgctatcaattgattcctgttattccatacataatgagaaccggactcttgagtaggtaaggtaataagtcgccgatcacgcaaatcataaaccatgatcttggtatgccgcctcatataatccccatcggttggtattttccggtataagaaagaaagataccgaccgtctttcgagaactccgaatgggttacaaaatgcatatatccctgcctataggattcatcttccatctgtgccaactcagacaaagagataagcaactctgaagtattctcctttaaatccaccaagaacaaaccgctatctttaggtgccggatcatccaatttccctccatcccgataaggataaccatacccgggcatacaacgctccaagcgctcataactaaaagaagaagccaaagatctttgctcatcttgatagaccgcatcaatcgggcagtctattacttggtattcccctgtcgataaatcatgaatcttagacacaagccgattcgctatcgccgtattataaatcatccggttcttatccaaccattgcagcctgcatcctttatgataattccatgcgtaagaggtatccaccctatgaaagtcctttatagggccttgttccaaatcaaaatatccgacatccagtccatcagacggtaaaggcatacgtaaatccaacctattttgattcgccaatagcttggtctcatcaaaagaaaaaggcgtgacatcgtgaaatccaaaaaagaagccttcccggtattgatagggagaggcgaaatactccttcttccttggcagcaaatcaaatatgccttgatacatattccgcacgaactgctttaaggctggatttttacggacgaggttatagatggtagattctagtttattcataaatcaacatgattattttttcaattcagagacaactgccttaaacttccctgcttttgtacggggaatctcatccacatactcaaattttacctttatggtagggcttatccattgagatatatttaccaacaatttcttctccgtagccacactataggaattccttctcacaatacgtaaaatcatttcaccaaatactttttggactacttgacactccttcacctccgacgtatctttgaaaatataatccagacgctgaatgtgaagcccctctggtgtaactatatagtcttcattgcgaccaacaatatcttctataatttggctatgtaatccacatccacattcccggtcggagaacactgccgtatccccattttgataacggataaaaggcataccaagattagcgaacccggtagccaaaatctcaccctgcaccccattctctacgggaacagccagatccaattccatatgaccaatctcgaaatcctcgtgataaaccgagtgggtacaatgggtagcgatagcggcttgctcagaaaaactatacaactcatggatttggacacctttaaaaacagcctgtaagatgtttttctgattctcgtataacttctcggcacccgtgaatatgtgtttaggaggaaaatccaaagccatcttcacattagtcaactcatttgcgaaagctgccataatagatggatatcctataaacatctctatactctttgaattaatccaatttacaatatctcgtattttcacttcattcagctgatgcatattgatgaaataacggttcaagacacgatcatatctccagtaaggaggttttgaggttgaaataggaacgataggacgaccggaaaagttaacgcaagcctttcccaaagtaaaaccaaacctatttttatacctttggtctaccgcccaataataagctgcgctatatttagtccaatagaagtccaacgcttttcccgttgaaccactggtgttaaatcgtataagttcctttcggggaatattatcagccactaggccaagccaattctcacggatttcttccttcgtcagaatcgggaacttttgcaagtctcccaattgcttaaaatcagaaggggataaacctacgtcagtatatttctttcgataataaggacagtgattataagcttgttccaatattttaaaggtatgttcttctttataagaacgaatctgttcttttgaccaaccatgggttgagttcaagaagtccaagatcttataaaagtcatcgttaaaacgctgtcgctttagtttgtaaccgtgaagggatacggctatattctgcagccaataaggtagggatgagtaaatagtaattttattcatttgatatcatatagattaaattgtcatatggcccattaccaagttcatccgagatttggggtgatgaactaatttatagtttatctaaaagtaagtttagcaaaaattcgcagcctattatttcactagattaaaatagaccaaaagcctccataatgtatctttattttctgtttttacgacatcatataatcgacttcctttatgaaaccattgataaaacaaatctacatgataataatgtaaacctatttgagaaacaggtaagaaatccgcacctgatagcctcgccatgacatagaaccacaaatcatccaaaagaggacataattctgaacgaagttgctcattaaacaccattttatccaacactttttgaggatataaaactcctctctctcctatcggaaaagtacatttatatccgttcttataactatacgtataagaataataaaacaatattttatttggaaacaatacatattgtttatacaaaccatatattagatttgatgaataatagacatcatcatccaccgtcacaatagctttatccgaatattcctctaaagcggggattagcttcttataagaacgaatatctttacaaaacatcacttttaatcgtttccattctatcattctacgcaaagaaaaaggtaagttatctttattccaattatcataatccaaccataagacaatctcttctggctccaccgtctgttttaaaattgaaaaaatcgtatatggaacactttttgatactcttcgtccataactagtgagtgataccacaacattctttgcgcactttgatgattttttaggaggaatattcaacaacaaatgaaaccaaactttgaatttcaatacattcccaataattgaatttaacaacaaccttattttcattataacctcactattatctacattattcataactaacatatatagtttaacaaataaaacatattattattttaacaacctttctgttataaatttttctatatcattatccaaatcaaatagagaacgaacattattataagtaactaaagctcctttagataaattagaatgaaagtttacatcattacataatgccaaaatagcattctttaaagccttcacattcttattctctaccaatataccattttttccatcctttaaagtaaatggaatagctgaattattaaatgcaataacaggaagcccataagacatagcctcaattagtaccataccgtatccctctaacaatgaaggaaaaacgaaacaatacgctttagaataataatttctcaattcttcgtcagacacacgaccagaaaaagagacaacatcttctaagccattttttgacaccaatattctcaatttattatagtaatttttagaactaatatttcctactacatctaagtgaatatttttccgttcttgtttattcatcattcctaaagcttttatcagataaaaaacacctttccttttatatacagtaccgacataaagcaatcttattttttcatgacatgaacaaggtcgtttttcttttctaaatgccatttctaaaaatattacttgacaatgtggaacaatacgtcttataatcgtacgagtgtacggattaggagttatgactgcggacgacaagatcagtccaatgcgttctaatattgaaaataaaaatctctttacccctctcataccttgataacgaaaatgatgatgaataatgtaaatatccaagtgtgaataaaacaatctgaagagcaaaataatccacaaagattgggccacccagccgctatttaaaaaaatagcatgacaagaaataatcttttcacgatgttgccaaatacgcacaggaagataccatttattaacagaacctgtatctgtatctgtaaaataagagacttcaactttaagagatgatgctatctttttaaacaaataagaatcatacacttcgcctccagttgttggaaacatataatttcctataggatataggatacaaattttcttttttatttccataacattctttttgataagaacaacaaaatccacattatcaacaatgtgtatattgtatttgataattctgaaatgtctccacttgttccaaaaccgatagttagtagaaaagcaatacttgaagcatttggaaatatttttcctgtcaacttaaatattatattgataagaaatatagtgaagaacagattaagtaaaaatacatatggcgattttatatacgaaatgataaacactccaataactccagccatagtagaatagttctcttccttagaattctttatttgcatttgaacataagtacctacgcttttaaattctggtctatacccccaataatgtagagtatcatataaataaaacaaactaggaatatattctatatcattagctatctgtaatgatttttgaaatatatatgcattgttagaaaaactacttacacgtccacacattttactaaatacaatgtcataattatttatattttcagctatttcttcccctcttaattgagacctaaaattaaatgcagttgaaattatcacaggaagcatacacattattaccaaaacaaaaaagaaatttcgaatgaataaaatccttactttctttccattcctaaacaagtataatagtaataacaaaaagcaaccgcccaaagaatgagcagataaagattcaattataaacaatataacggtgataacaatatttttcttactatttgaaagcagaagaaaaactattacccaaggacgtggcaataatttcgatattgctgaacgaacataagaaaataaacttccatcaatatgcgttgaggttcccatagctccataattcataaaatgcagacctatatgaagaaagagcaggcaccatgtgatattacgaataattataatattaaaacaagttggaacacgaacagcctccttaagataatattttgcatacagtttatatatgaacacataaggtatagctgtcaaaattgccataagcaacaaaatatctaccgacaacaaaacagttccttgaaaaaaatcaccattgtatgtattaaatataactgtatataaatagctaaagaagactgctaacaaatatatcagaacaataatttttccatcatacatggctattttaatagttgattgcataggtactcagtaaatatttataaatctttgtatagtaagcatccaacccctatagccatatctcttagccccagtgttcactggggtttgagaggtatagtaagattggactaatttgttatttatttgattttaacaaagtaattcttgtgtcatgagttcataatcccttcggccacctgcaatcatactgaagtatcgcctgaaaaaatctaaaggtggcttctttagaagcttgcacgtttccactaaggataaatatatggcagagacacgaccaccttcctcactgctaaaacctccgaagcttttccgcagattcgtaaatgggcgtaccgcacgttcgcagcaattattgtctatgaaaacatttcccacattcacatagcctatcagctctatccagttgttgagcatgtatttcaatgcatgatgcaacttgtctgatattttttctgttttggcatcgctgtccgataatagtttttcagccttctgcctcaactcatttagaaccggtatagccatcagctttctggcattgacaacttcctgctctgtcctgtgaggcatcatgctgtcaaactctaccttatacaggagttttatcagttcgataaaggcttcggctttaagatccttgtaatcgcagaatgcagccacgtagatgcgtctcacatgagcccagcagcacaaatgggtacattcatccagattgttgaggtacttgtaggcggcataggcatccgtcattaaagaaccttggaaatcggcaaggaacctctctatgacctcacgcttgcgtttgccgaacagatagtagcaaaccttggtcgtcagattgacaagtacccacatataacgtttgcgatagtggatttcaccattggcatccttgaccttggtatccacccatgtctcgtcacagtatagcgtggtacccttttgcaagagtttcttcttaatgctcttcaatgagccttccaaaaaccttgagccttcggacagccagttcaggatggtctgtttggacattctcatcttctcgttaaacatgcggaacatctcccggcctgtagatatggcatactggtagcggtttcaaatgtcaatctcacaaaactcatgttgttatcaaaacgctggatgtacagttggtattcattatgctcatgacggattatcttcaccagtttctggtctttggaagtgaagacatacgctgtcccgtcttctggatcctgaccaagagtacgcactactccgcataatttatcatatcctccacgcatatccttatagttggggatatacttataactgacagcaccactcaaagtgaacataacctctcgattttctggatgaaacccaagagctccaagtagctcagtttgtgatgctctattcggatgccattgcttagcatgatgttgacatgagaaatcatacattcttgctgcggcttctcctgcgaaactgtagccactgactccgaaggacccggagtaccatcgaccacacagtcgactatggatggctgttgaaaacgagtcttgtaccacttttcaaaagatctgtagggaacaccattggattcaaaaaactgcgtgactgatatgcctttctttacaccttcatcggaatagcgtttccaaaggatttcgatgtctttactacttgttgccattgctttctatttttgaagttttgacaaagatagaagctagaacttagagacacaaaatagcggttggatgcttacggtagattggtggtttacaaaatgcttataaaattctcatgtatattatttccatataaatagaactatgtatttaatacgttttatagcaacagatatcttcttcctgctactcaaaaaataaaaaaacatacgagacaacaatgttatacaatataaaaataaggctatataagttcttaaaatattagaagtaagtttataataagtgacatgtccatgttcctcatattgtattttccaatcactgatatgattctcgaaactaccacctactagatgttggatacatgcttggggaacagaatgtacttccaaacctttacaattaagacgataacataattctgtttcttcataatacataaaaaacttaggagaaaaaccgcccaattgattaaacacacactgaggcatcatcaaatcagcaccagtgatataactaacaggtattgctttgtcggtaaaattatgctctctattgcatccccataaagtacgtgctatataatcatgcagtaagttattcaactcccatcggataccggggaaccaacggcgaaacgaatgacatggttgaagatctatattatatagatttccgccacaagcaccaacagacaaatgagaatctaaatattgagacaatatagaaatagcatcattaagcaaaatagtatctgggttcaaaaataaaatatttcgtcctttcgcaagtttaactccctcattattagcccttccaaaacccatattttcaggtaaagaaacacattttactttaggatattgttgttgtatataagtcgcaaaatcatcattagaattattgtcaacaactattatctcataactaattttccgtgttaaccgttgtatagaattcaaacatttcaatatcaaggacacagttttataattcactattataatagaaacatccatattcataagtacattttacaaatgcaaaacagtctgttatattttgatttattttctgtcatatataataaatagacacattattttctcttttatttgaaacattatcaaaatctatattttaaagaataaattcttaattcgttctccaactaaagatcttattattatttgcaataacatccacaaaataccagctaataccaccgcacatcccacccctagcaattcattatcaatccatcgtccacagcccaaacaaattactacactaggcaaagagaacaacacattttttcctattgccttgataggaatcaagattaattcttgcgatagcacataccacacatacattccggtcacccccatttctgaacacagtaatacgactgctgagcccacgcttttcacagaaggaaccaccagcaaattaatcaacaagctgacaaccgctcctatgattgatgctatcaatagtaccttatccttcttcatcggcatcaatacctgtattgccaatacctgagccacacctacggcgaacgccgctggcatgataatccgcatgggtaatatcgctccctcatagccgggaccggataggatataaacaatctgaggggccattatcatactacagaggatcaaggggatgcagcaagtcgccatcacagagaacgaacgattcaccaattcttggaaacgatccttctctccattcgccagcaaggaactcatccgaggcaacatgacattcgtgaatgcggtaaaaaagcccaagatcacggagtacaacttaaacgctgttgtataataacctacctccgtgttattagacaccagtcccaaatacatcacattaaaggtgagatacatcgaggtcatcaacgtataaatacccaatgtcacgttctgtttaagatacttgaataattgaatattattccatctaacccgtacgaattttcgaatatataattgattgataagagcgttcaacacaaccactcctaccgtgagtataaaataaagtcgatagtctgacgtatctcttacgaataggaaaacactgattatataaagaacttttataaggatacttctcaacgtaatataccggaaattctctactcccgtaaaaaaccattccactagaaatacggtaaaaagtatctttgccgttcctatataaaacaactcgtcatattgacacagcttaggtattgtagatatacaaagtagatatatacccaacgataccaaggtgaataacagattcaaggctaacatgctcgaatacacttgatccctacgtttcttatcctcttttaccgccgctatctctcgaacgcctaggagcccaacccccattgtagcgaacaataagaaataattcaccgtattatccacaaaattaaccaaaccgatacgttcaacacctagcacccgagccacgtatggaaacgtaatgaaattgatcaaataagtggaaagagtcagtacgcttttataagcgaagtttttctttatagaaggttgtgacataagtaataagcgcccgatttaaggcatgccctttgattaaacagttagaatctaaagtgttttgaccgttccaaaacgacctaaatacgcttttgggaacgctcagataaggtaggggtcttcttttttgccaaatattccgctttacgaatgaaatcttcagcaacagccccttctaaaaccggaatattttttatagtaatcgccataccatgctattttataagaacatatagaaaccatttctttctttgctgcaaacatttcccctcaaaataagcgattatcttcctcaacccctctctttctccaccctctcccgcaccttccccgatagcggatagctcagctccagtatccggctgcgggaacatcggagttcatttcgctcgggctcacgctccttctccgggaaatggaaggacaccaagtggaggaaggtggcgtagacacggtctagtgattccagccgcagactaccatccggatggcttggactcaacttcgacagtgtgtggcggctgatacccaagaacacggaagcgtctcgcagggaggacagaccccaacgatccaagatgaggtatacctcggaggacgccacacgaatccaagggttcagatccgagctttgcggttcgatcattacgtctcaagggggaaatctctccatggtgaaacgctaaaaccttgaagaaacattaaaataggttataatactcttaaattggcgcacccatgagtgcgccacccacaaattcaaaggctatatctttacctgcgatccgaagcgaaagccttggatcatcattgtttaaaccttattaaaaaacaaacacaatggaagaatccatcatgtctttttacaacgctccgattaccaatcaagtgccaaacggagtggtcagtatcatccaattgcatgcctatatcagcaccaatgaatggctacgggaacggacgagccgcacacgtgtcgcactggacgacgagaaacgcttcaagcagttgaagcaaagcctcctgccctatgtcacgcccgccggggtattctcctaccgaaaggaggaccggttgctttttccctcgggtgaactggttatcgatatcgatcatctcgcctcgcccaaggaggcttgtacgtggcgagacacgctgttcgccgatgagcggctacgccccgacctcgccttcatcagccccagtaacacaggcgtaaagctcttcgtgccttatcgtttgtccgttaccgccacgatcgagtgggccttcgacgaggcacgacgatcggcttgggaataccttgagtggagatacggactgaaagccgatacctcaaacgccgacctgtcaagggcttgcttcctctgccacgactcttcagccaggctgagaaatcgtggcaattgaaaattgagaattgaaaattatatattaccatgaacactattcaagatttagagcggctcgtggccgctatcgagaaacagggggcgaacgtcgctcccacctatcaagagtatatgccgctggccttcgctatcgccaacgattgcggcgaggcgggacggtcgttgctccatcgcatctgccgtatctcggaaaagtatgtgtccgacgaggcggacagactcttcgaccacgccctcaaagggggtaacgggcgaaacggaatcgggtctgtctatcactgggcagagaccgctggcgtgaaactcgacaagcaactggccggtaccgcccggagctacgccgggaaacaacccgaaacttgcgaacttgcaaacttgcagccctctcatcctctctcacacacctgcgcacatgaggcgtacattaatatgcccgtcttcggaaactatgattggccccctttcttgaaccagctcatcgactgcggtgactccccggcgcaacgggatatcctgctgctaggtgccgtcaccgtactaggcgctaccctcaacaagcacttgcgcatactctacggacgtaaataccattatccctgcctgcaaaccttcatcgtggcgcctcccgcctcgggaaaaggggcgctcacttgggtacgccacctagccgaaccgatccacgaggcaatgatggaggaattcaaatccctacgcaaggaataccggctggagaaggcacggtggggttccctaggcaaggagcgggcgaaaacccctgagccggaagagccaaagcctaagatgttcctgatcgccggcgataattccggaacgggcgtattggagaacctcatcgaggcggacggcgtggggctgatctgcgagactgaggcggataccgtcagcactgctatcggcacggattacggccattggagcgataccttgcgcaaatgctacgatcatgaccgactagcctttaaccggcgtatgaatcatgagtatctggaatgtatgaaatcttttctcagtgtcttgttaagcgggacaccggcacaggtgaaaccgctcattccctcggccgagaacggattgttctcacgccagatgttttactatatgccctccatcaccgaatgggtaaaccagttcgacctgtccgatgaggattatgattcccggttcaccggatggggcaaacagtggaagacgttcatcgagtggctcggcgcttccgtgaatctcattcagctcaagctgtccgaagagcaaaaaatccgtttcaacgaacgtttcgcacaacttttcggccatgcgggtttcacgcatgggggagccatgagaagcaccgtggcacgtatcgccatcaacatctgccgaatcctaagcgtggtggccctgctacgagccacggaaaaactcctcccgccacacaaaacaattttcaattctcaattctccattttcaaatgccccggtctctccccttccgatgacataccggaagagaatgtccgagacggtatcgtaccgaaactggacctgacagcgacagaggctgatttcgaggccgtgctcaacctcaccgagcctctttaccggcacgcttgccatatcctgtctatcctgcccgctaccgacgtgcaacaacgggaacctactcctcaagaggcgctattcgatgccctccccctcgccttcaaccgccaagaggcgcttcatgaggcaaagaagatcggcatgggtaccgataccctagattctcacttacggcgtatgctggaaaagggcgtgatccaaaagaacgcacggggtgaatatatattcacggccaaacaacgccagacaccccaatcccctttataatgtacatgtatgtgtgtgaggtatggaaccgaccgcaagtttgcaagttcgcaagtttcattttcccagattcataatccataaacaataaatcaaatgtccttaccattaagaaagtccgcattggcggcatcctatttcccggaactggcctcccatcaagcctgtaaccgtctacgccgctggatcatccgatgcacggagctgtacgacaagctgcgggaaacgggctaccgtcccgagcaacgtatattcacgccacgacaagtggggttgatcatccactacctcggagaaccgtaaattagttgacaggtgacaagtgacagttgcgcacggcggtgaattaactgccacttgtcaactatcaactagaacgcccatccaaggctccttataatgcccattcaaagaggcttacaatgcctatccaaaggggcttacgatgggcagcgtagtccggcggccattggctatcattattcattgttaattattcattattcattccctaaggtatcacccggcatcaccgccccttacggcggaacctatctttgtaatgttgatcaacaaacaattaattttctattatcaacttttaattttctattaccatgccacaagcatttcaagcacgaaagttttttatccccaagacggatcccaagcctaggacgcaagattttcattcttgaaagaggggttcgattcccctatgggctaccaatcaaaaggagagagataagtttatggcttatctctctccttttttactatacccgtccttttttcgctattttcacatcccccacttcgctatctcgataaaaatcactacatttgttagatttttttgaggacatagataattacagattttaaagaaagataaactcatgagtgaagaaattaagaatacttctacagagtactccgcagatagtattcaagtacttgaagggttagaggcagtacgaaaaaggccatccatgtatattggcgataccagcgagaaaggtctccatcacttagtgtatgaggtcgtagataactccatagacgaagcgctagccggatattgtacatacatcgacgtggtaatcaatgaggacaactcgatcacggttaccgacgacggccgtggtatccccgtggatattcatgagaaagaaggtaaatcagccttggaggtagtactgacagtgctgcacgccggcggtaagttcgacaagggaacctataaagtatccggtggtttgcacggtgtgggtgtatcttgtgtgaatgcactctctacctatctgaaagcggaagttcgcaggaacggcaaagtacatatgcaggagttctcttgcggaaagccgttgcacgacgtacaggttatcgataatacggataaaacaggtactacgatctctttcaagccggacggttctatctttacggtcacggaatacaagtatgatatcttggctacccgtttgcgtgaattagcgttcttgaacgcaggtattacgctacgtctgacagataagcgagttctgaaagaagacggttcattcaagtccgaggtattccattcggatgagggattgaaagagtttgtccgctatatcgaccgttctaaagagaaactgattccagacgtaatccatatcgttaccgagaagcagggtatccctgtcgaggtggcgttaacttataatacttcttacaatgagagcgtattctcttacgtaaatgatattaacacgatagaaggtggtacacacttagccggtttccgccgtggcctgacccgtacgttgaaaaagtacgccgaggattctaaattattggagaaagccaaggtggagattcaaggggatgacttccgtgaaggtttgaccgccgttatctctatcaaggtagccgaacctcagttcgagggacagacaaagacgaagctgggtaatagcgaggttaccggtgcagtggatatggcgatcggtgaggcgttaggctattatttggaagaacatccgaaagaggcgaaaataatcgtcgacaaggtgatcttggccgctcaagcccgtcatgccgctcgtaaggctcgcgaattggtacaacgcaaatctccgctgacaggaggtgggcttcccggtaaattggcggactgttcctctaaagacgcgtcgatctgcgaattgttccttgtcgagggagactccgcaggtggtacggctaagcaaggacgcgaccgtaacttccaagcgatcctaccgttgcgcggtaagatcttgaacgtggagaaagcgatggatcataagatcttcgaaagcgaggaaatccagaacatctatcgtgcgatgggtgtgaccgtcggtacggaggatgacccgaaagcgttgaacatggagaagctgcgttaccacaaggtgattatcatgaccgatgccgatgtggacggtagccacatcgccacattgatcttgaccttcttcttccgccgtatgcgttccttgatcgagaacggatatgtgtatttggcgactcctcccctctatttgtgtaagaaaggtaaggttgaggaatattgctggaccgagcaacaacgtcagcagttcatcttaaaatatggaggaggcaacgagaactcgatccatacacaacgatacaaaggtttgggagaaatgaacgaccatcaattgtgggatacgaccatgaacccggaaaaccgtacgttaaagcaaatcacgatcgacaacgcagccgaggctgaccaaatcttcgccatgttgatgggtgaagacgtaggccctcgccgcgagtttatcgaggaaaacgctacatatgctaacatagatgcttaaaatcatgaaagtccgtcgtccgaatctagaggccctatacaaagaagttgataattatataccggctaaagaaagccttcaacctccccgaataggaatatccgctaaccggagagacggactttcctgtatagccgagacctacgtgcaagccgtgctggacgcggggggagccccggtacttatcccagtgatcacggatctgaaagcattgaccgtactggtttccgaactagacggattggttatgagcgggggtggagacatcaatccgctctatttgcatgaggagcctatcccgcaattgcaagacgtagatacgctacgtgacgaatacgatttgatcttgcttcgcttggccgctaaccgacaaattccgatcatgggtatttgccgagggcatcagatcatgaatgtagcgttcggaggaagtgtctatcaagacatccattcacaagccgatcacccgctattgaaacacagccagacattggcgcgggaatatccgtcgcatacggtaactctcgaaccgggaacgaaccggctacgcactattttcaatggagaaaaacaaatccttgtcaactctttccaccatcaagcggtaaaagaggtcgcccccggatttagggcgacagcgaccgccccggatggaatcaatgaggctatggaacatacggagaaaacgatattcggtgtacaatggcatccggaggccatggctccgcaaggggatgaggccatgaaagccctattcgcttaccatatcgagaatgcccgccgtttcgcgaaagccaaagcgatccatcaacagatcgtgacgatcgattcccatacagataccccaatgatctttcccggtgaatttaatatcggggagaaagaaggagggaaagtgaatcttccttttatggaagaaggacgtatcgacgcgacctttatggtcgcctataccccgcaaggtaaacgagatgaggcatccttacaggcagcgacagcgtatgcgatagaacggctgaatcaagtaaaacgccagcaaaccttacatccggaccggatggctatagcgactaccccccaagagatccggacgattaaggcgcaagggaaaaaagcgatctgcctcggcatcgagaacgggtacgctttagggaagcagatcgaaaacctacggatgttcaaggagatgggagtttcttatatcaccttatgccataatggggataacgatatttgtgattccgctagaggaaaacaggaatggaaaggactaagtcctttcggtaaggaagtggtaaaagagatgaaccgattaggaatcatggttgatatctcgcatgcggcggaaagtaccttttatcaggtaatggaagtgagcgagacgccaatcatagcctcccactcttccgcacgtgcgctttgcgatcatcctcgtaacttaacagatgatcagctgaaagcactggctgctcaagggggtgtcgcccaaatctgcctatacaaaggattcatcaataaggaagaggacaaagcttctttaagcgacgctatccgccatatcaatcatatcgtggatttaatcggtatcgatcatgtaggaatcggctcggattttgacggagacggggaactgatcggttgctcggctaccaacgagttgattaacattaccgtccgacttttagaagaaggatatacggaagaagatatacggaaaatatggggtggaaacttgctaagggttatgaccgctatacaagatttcccaaacaaatagcaaacgaaaacaactacatattatgaaaaagatcttatacacagcaatatgcgcctgtagtatcttatgtggagcacaggcacagacacccggatcggaggtacccaacttaaaaaagctatatgagttgacagactcttgcgatgtaaacgtgcgggcacgattctccccattgatcgggatttccgctagtatctccaatggtgcttcccgggtgggggccacctatatccaatccatcgtaaaggcagggggaactccggttatcatcccggctgttactgacggtaaggtactcagaaatatcgtatcgaatttagacgggctagttcttataggaggagcggatgtaaaccctctatggtatgaggaggagcctcgggaaaagctggaggaagtcgatccggtacgcgatttgtatgagttgaaactaatcaagatggctaccgaccaaaatattcccgtcttaggcatatgccggggattgcaactgttgaatgtagcgtttggcggtacgctttaccaagacatcccctcacaacgtggcgatcattctgtcaagcataggcaagatttacccagttcgtatggctcacaccgtgtctttgttgacgcgaactcacagctagccactattctagggaaagataccttagccgtaaactctcttcatcatcaagcgatcaaggagttggcgcctatcttcaaggctaccgcttatgcgcccgacagtattatcgaggctatcgacgcttatccgaaccgatccatcatgggagttcaatggcatccggaagcattgacttacggaggcgacactacgatgttaaagatattccaccatctgataggaaaggccgagactctccaccaagccaaagagatgcacaagcatttcctttccgtagatacacataccgatactcctttctggtttaaacgtgccggattcagcatcgccgaccgggaacgtaaccgggtaaacatccctaagatgcaagaagggaaactagacggggtgttccttgcggccttcatcggacaaggtaaacgtgatgaggcctctttacaagaagccgtacaaaaagtaacaggcttgatcgaaggtattcgcaagcaagctgaattgaataaggatttatgtggcatcgccgttacgaaccaagacttcatccgcttgaaaaatgaagggaaaaaagcgttctttatcggtatagagaatggatacggtattggtaaggacttggcgaatatcgctaagttcaaggcgatgggtgtcaattatatcacgctctgccactcctacgataacgatatttgcgactcatccacccataccaagaaagaatgggacggtttaagtccgtttggcgaagaggtcgtgaaagagatgaatcgccaaggtatcatggtggatatgtctcatgcctctgagaaggcattttgggatgttatcaaattgtccaaggccccgatcatctgctcgcattcctcatccatggcgatgtgcaagcacgaccgtaacctgaccgacgaacaactaaaggcccttgcccaaaatggaggcgtagcgcaagtttgcttgctcgaccgctatatcaatgaggattataaaaacgcgagccttaccgacgcaatcgaacatatcgatcatatggtgaaagtcgccggtatcgatcatgtaggtatcggctctgattttgatggcggtggcggaattatcggttgcgaaagtgacaacgatttcatacagatcactgttaaattaatagagaaaggatatacagaggaagatatcgccaagatatggggtggaaacttgatgcgtgtattagacgaggttcaagcgactgcctccgtaaaaacattataaacaaaacagatttatgatcagattattttttgcgttattgagttttgctcttttatcatgtggagccaaaggaaccaaagagacaggtaatatgccggagatcaaaaaacaaccgatcacttcagctgttcccgatttcaacgcagacagcgcttacgcctatgtagcgaaccaagtcgcttttggtccccgtgtgcctaacacggcggctcataaagcatgcggggattacttagcgtctgaattgaagcgctttggcgccaaagtctaccaacaggaagcgatactgaccgcctacgacggaacgaagctggaagcgagaaacatcataggctcgtttgatccggagaatagtaaacgtgttttactattcgcgcattgggacagccgtccctattcggaccacgatcccgatccttccaagcaccggactccattggacggggcggacgatggcggtagcggcgtaggtgccttattggagatcgcccgtcaaatcgggcaaaaagccccgggtatcggcatcgatattattttcttcgacgcagaggattatggtacgccggaattcgtaaccgattatacaccggatagctggtgcctaggtacccagttctgggcaaaaaatccgcatgtccctaattatacggcggaatacggaatcttattggatatggtgggcggcaagaacgccacgtttttcaaggagcaacaatccttacgtgcggcagccccgatcgtcgagatggtatggagcgcggcccgcgatctgggatatggcaaatatttcattaacgccgcaggtggagccattacagacgatcaccaatatgtgattagcggacgtaatatcccgagtatcgacatcattaactacgaccctgagtctaaaacaggtttcgccagttattggcatactcaaaaagataatatggaaaatatagaccgtgagactctaaaagctgccggtcaaaccgtactggaagtaatatacaatcgataaaatactgataaaatgacaatcaatgaacttcaagacaatgtaatcgaagaattctcagtcttcgatgattggatggataaatatgcgttattaatagatctgggaaactcccttcccccgcttgatgagaaatataaaacggaaagcaacttgatcgagggttgtcaaagccgggtttggttccaagcggattatgtggatggaaagattattttccaaggagaaagcgatgccgtgatcgtaaaaggtatcgtatctttgctgatacagatcttatcgggccatacccctcaagaaatcttggatgcggatctatactttatagacaaggtaggattaaaagagcatttatcccctacccgttccaacgggttggtagcgatggtgaagcaaatgcgtctgtacgcgatggcttaccgggcaaaggaacaacaataaaaacaggtgttttcacacgtatataggcacgagccgatacgtatatacgtgtaagcctacaccgatataggcatagcctcatacgtatatacgcataaggttatgcctatatacgtattaaaaaccgagtgtaagctgctccggtaagagcgtaaaagtcttgcgatgatagggcgtgatcccacaggtacgaatcgcttccctgtgggccttggtaggatagcctttattgtccagccaatgataagcggggtattccaaggccaattcattcatataatcatcccgatacgttttagctaatacagaagcggcggcgatactcaggtattttccgtcgccttttactacggtcgtatgcggaatatcgggataaggggtaaaacggtttccatcgatcaataaatgttctggaagtactttcaattgctcgatcgcacgatgcatagccaagaaagaggctttcaaaatattaatcttatcgatctcttccggactgacgatgcctaccgcccaagcgatcgcctcacgctcgataacggggcgaagcttataccgtttcttctcgcttaattgcttgctatcgtttaaatcctcattcttaaaatcttccggaagaatcacggcggcggcgaataccgcacccgccaagcagcctcttcccgcctcatcacaaccggcctctatacgcccggtttccatatagggtaataacatatcccagtttattatttatcgtatatatagcttacattatttttgctccttcacaatccaaaggcgaagcacgaaccaagcgaatgccgtagcggcgatcaccccgcaagtattcgccaagaaatcaaaccaatccccaccccggtacgtcgtacaatattcttgcaatatctcaataatcccactcataacgatcgggcataaaactgccccgatccaagcatgccataataccgtctcatacttccggtgattccgcaagaactccagccatagcatacccgacatccccccatacatacagaaatgaaccaccttgtccacacccgggaataaagggatatcatccatcttcggcggcttaaagaacgacaagtaaataacgatcaatataatcgccagtgaaaacggatatttcttaatataatacatcatactcaaaacatcttccgaactcgttccacacctgcgatgaacgtatcgatctcctctttcgtattataaaaagagaaagacgcccgcaccgtcccctcgatccctaaggcatgcatcaaaggctgggcacaatgatgccctgtacgaaccgctattcccaaacggtccagcaacatccccatatcgtaatgatggatattacccaccaaaaaagaaagcaccgctcctttatgatccgcttgtccgaaaatacgcatcccttcgatcgtatttaatccagcggtcgcataccgcaaaagctcatcctcataagcagctatattctctataccgatctggtctacataccgcaaggcttccgccaacgccgtgctaccaatataatccggagttcccgcctcaaacttaaagggaagctcattaaaagttgtcttctcgaacgagaccgtagcgatcatctcgcctcctccctgatatggaggaagtttatccaaccactcctctttaccatacaagaccccgatacccgtcggtccgtaaatcttatgaccagagaaaacatagaactccgcatccaagtcctgcacatccaccttcatatgcggaacggcttgagccccgtctaccaacaccggcacgccttgttcatgagcgatctcgatcatcgcctttaccggatttaccgtacccaagacgttagacacatgagtcacggaaaccagacgagtcttatccgagaataatttacgatactcatccagatttaactcccctttctcattcatcgggatcaccttcaacgtaatacctttccgggccgcttgtatctgccaaggaacgatattggaatgatgctccataacggacacgatcacctcatcccctgccgacatacattcatccgtaaagctggaagcgatcagattgatggattccgtagttccccgggtaaaaataatctcattcgaggaacgggcattcaagaaatgctgtaccgttttgcgagcctcctcatgcgcctctgtcgccgcttggctcaagaaatgtacgcctcggtggatattggcgtttacgttataatatccattctctatcttttctaccacttgacgaggtttctgggtagtagcgccattatcaaaatatataagcggtttatcgtatatcttatgatccaagatcggaaagtcttttcggatcgcttgaacgtctaacatagtcttacttctttttgtcttacaattacgagagccaaagatacaaaaaaaaggctttctcgctgaaagaaagccttttttatcattacctaacagatattacgcctacactttattctctactcgcacgcctacttttctcttccaaagtcaaagtacggagactctgtacgggcgttgtccattaaggatactagttcttttaccttatcgggatacttctccgctagattcgtatcctcatgtatatcattacttaaatcatacagttccaatatagtttcacccacgatcggttgccggattagtttccatttaccggagcgtaatgcttcccggccattcaactcgtgaaattcccaatataaataatcatgggcctgttgatttttctttgataacaaggttggtaagaaagagattccatccatctgttcgggcaaaaccgtacctgtaagctctgccaacgtaggcatgacatcccagaatgcgcttatatgatccgattgagctccggccttgatcgtacccgggcaccatgccaccataggtatacggatacctccttcatatacatcccgtttgatccccctgaaaggtccgtagctcttgaaaaagtccggatcagctccaccctcatgatgcgggccgttatcgctggtaaaaatcacgatcgtattcttatccaaacccaactctttcaattcagccattacatcccccacgtattcatccaaccgggagaccatggcggcaaaggaggccaagggtttctccgaggtgttataaccgccatacactttatcaaacttaccaatataaggagtctcctcgaatgagttctcgtacatcttataaatagaatcatgcggaagattcaattccgcatgaggcagcgtataagtaagcatcgcaaagaatggttgctccttatgatcccggatgaacttcaaagcttgctcatgaatcaaatcttgtgaatatgtcttgcaagcattgttctcgttttcaggaaaaagaaccttctcctcattatgccataaatgatccggatagaaggaatgcgactgccgttggcaattatacccataaaactcatcgaagcccatcttattaggaatggagacagagcccggatttcccaacccccatttaccaaagataccggtcgtataaccggccgatttcattaatttacccaacgtataggtatcctcccgcatcggctgttggccttcgggcgtgatctcccggtttccccggacttgcgtatgtcccgtatgcaatccggtcatcaaggagcaacgggaaggggcactcaccgtacatccggcataatgctgcgtgaacaacattccctccttcgccatccggtctatattgggagtcttgataatctgttggccataacagccaacatctccatatcctaaatcatccgctaagatatacacaacattcataggacgctccggagctttttcgcaaccggacattccgataagcagcaatgtcccggatatacataaagtcaattgtgttttcatatacctttaaaataaatagaagtgttagaaaccaattacaatcttctgatcctgattcgtagacaaacggttcgtccgtaccttaacccttcccatacggtccgaggcatcgaagtaccagccttcttgtccggcattgaacgcttcgggggagatggcagatagcggcttcccggctacggttacgtttgacgggctggattctgagcggacatccaataggtaagtacgctcttggtaacgtcctttataatctcctttcgctttcgctatatccacggtgatcgttcctttctcaccttttggggaggaaacagagatcaaggtacaggcaaactcgcctttcttataatcacgggtgagaccgtcgtcttcatataaattgaaagaggtgtttccatagggatataagtccaaggtcaagacatccgcaggtttctcaccgacataattcatatccgggtacatcgggataatggcgccttgacggataaataccgggcaaatatccagtttagcctcatatttatccaaccacttgccaccctcgtatttctttccggtccaatagtcgtaccattctccggcagggaagtaaatactatcacgtacgttcttacgggtatatacaggagcaaccatcatccactcgccactcataaattgatattgggtggtcgtatcacgggtaaccacgtcatccgggaattccagtaccatcgcacgagccatcggtacaccggtcgtatgcgcctcatgacaataggtataggcgtacgggttcagacgcatcttcagctttaagaatttacggttgatatccgtgtacggatgcccatatacccaaggctgacggtcggcatccgcccagccgctcatggtcataaagatcggggtgaaaaccttccattgcaagtcgcgggtataggttttcggagaaccgccgaagataccgtccacatcgctagtagcggcgttcatggcggaaaggccggcacccgtgatcgtcgggatatggtaacggatataatcccagttgctcacttggtcaccgctccataccgtagaataccgctgagttccggcccaaccgcaaacagcccatacgaagcctcgttcgttcgtattgctctcgatcccctcgaatgcggatttacagccattcaaggcaaactcatagccttctccaacccaagccacatccaatttacacaggcgggtaccacatttaccaacctcgtaggcgatcttatccacaccattctctgtccacaagcccgtatggaagcctcgtttacctaattccgtcacaacagaatccaatttcacatagccgcaaccatagccatcgttcggcaagatccagccacggggcatatcatattccacatatttatcagcaacttggctgattacgtccggggtggattgaggccatccggtgcgctgttcccctttgttatagcagtcggcgtctcccatcgtaagcatccacatcgccggcataaaaggttttccggtgatatccgtatagtcgttcaataggtctttcaaggaagggccgtagaagtagaacgcatcaaagcgattctcgttatgcgtcaactgactggtgaagcccatcagcttaaagccatcatcatagttcttgtccagcatctccgtgccgttgaaggcataatggcccggggcaaacgtattgcggaatacgccatatcctttcgtggacatatagaagggagccgggttagaggattgatcctcatcccaaccggtcacctcgatatccgcttccttcccggcgtatgagaaattaccttgttgcataccgcaaccatagaaatcctcatcaccgctacggcgcatcgtttgggtcgttttcagtccgaaggcaagtggttcggcctcctcgtagatcacggcacggttattcttgtcatacatggcgaaacgaatagggttcttatagacacgtacgacacattggggagtcgtgaacttataatagctgccgttgtcggccatggagactctcgggttctttaccccataatctacaacgatcgagtttgccgccggattggtatactccccatccggtgccaaccagatacggaagatatcatcccggtaaaacatcaacttaaccttagcgtacccggagacgaactcatattccgtgttgctgatcttattgaacttcgtcaacttacccaagttcatacgggcagcgaacaggttcgcttttaatacgttgtttgacgaacgctcatccttcgggtattggatagcgaactctattttataggagcccatctgggttaggtcggtagcagggaaagctacctcatattcctcttgtttagcgatcggatgcccggaggcggttaccgtggcggttagtttctgaccgttgttcaaggaggcggttaccgtgaaatcctcgtctacgggctgggaaccaacgttcttcagcttcactttcaacacgtcttccttcgtgaacgtattcccgatttcttggtgtgaggtcactttctccaaagccaaatcatgcgcgaaaggctctgtcagctcaatatcatcgaccatccagtaccaagagaagatatcccgccagaagaaacgcaagtagacggttttctggttcgcggctacctcgctgatgttaatctcctcattcaccggggcgtgaagctgggtagcggcggggatcttatccatcacgttatactctttccaattcaccccgtcgttgctgacgccaacccaaaggccggcacgttttccggtgaaccaattattccaacgaaacaagtgctggaatttcaataccacatcgttctttcccgtgcaatcgatagcgctggtctggaaatagccgttcgggtattcctcccgttgattccacttcgtgatctcctccccggtgactacgcccggccggaattgcatatgatagccacggcttgtagatgcgatgggaggtgcttgttgctcgaactggaaagagccgggataaggctgatcggttacaatccattcacactttgccgatttcgttgaatcgacaatcatccagccgtcgggtaatttcccggcggagaaatcttctttccaaaaactttgttgtgcggacagggaggaaacgcaacctgtcagaagcatggatacaattagactttttatcatttgaattagttgattagatttaggcagtaaagatagtcttaatttacgagggttcgcaaacgttcgcgtgatttttattctcttttcgctgggcggaaacgtgttattatcaatggaatccttctatcttcgcgtatgtacaaccttgtcatataaatcaataaacatatatcatgaacagacatttattcttgagccttttactggcccttttcgcttccagtacgctttcagccgataaccttaaaatcgagccggccttctggtggagcggtatgaagaacccggaactccagctgatggtgtatggtaaggatatcgccggatatctccctagcgtgaaatatcccggcgtacagttgaaaagctcggtagcgttggaaagcccgaattacctattgatctatctggacgtggaaaaggccaagcccggcaggtttgatatcacgttcacgaaggacaaaaagagtttcaattactcgtatgagttgaaggcccgtaaaccgaacgccgatcggatcaaggggtttgactcttccgacgtgctttatctcatcatgccggatcgtttcgcgaacggagatccctcgaacgatcaaatcccgatgcgtaccgcttataaggtagaccgtaacagcccgaacgcccgtcacggaggcgacttggccggtatcgaacagcatttggattatatcgaggatctgggcgttaccgctatctggctgaacccggtattggagaatgatatggagggaggctcttatcacggatatgccacgacggattattatcgggtagacccacgcttcggcacgaacgaggattacgtccgcttgatcgagaagacacacgatcggggcatgcgtgtcgtaatggatatgatcttcaaccattgtggaagcgatcatccttggatgaaagatatccctagccacgactggtttaataatctcgataactacgtgcagaccaaccacgataaagaggcttatttcgatccttacgtctcggattatgataaggagacgatgctgaacggctggtttgtcccgagcatgccggacttgaaccaaaagaacccacatgtagccaaataccttatccagaactctatctggtggatcgagtattgcggcgtggatggtatccgtcaagatacgtatccgtatgccgacgtggacatgatgcggaattggtgtacggaggtcatgaacgagtatccggagtataacatcgtaggcgaggcgtggatgaactacacgatcggttccgcttattggcagaaaggcagccggttgaacttcggacaggatactgagttgaaatcggtaatggatttccgcttgatgggtatcgcgagtaaggcgttccatgaggagactgggtattccggaggcttgcacacgatcttcgagcatatgtgttatgattatgtatatcccgatatctataacgtattgcgtttcttggagaaccatgatacggatcgttttcttccctccatgcccgagtctgtcgatgatttgtacgcgttcaagcaaggggtgacattcttgttgacgatccccggtattccccagctctattacgggcaggagttgctgatgaatggcaccaaggagaagggagacggatatatccgcttggatgttcccggtggttggcccggcgacaaggtgaatcaattcgaggcatccggtcgcagcgaggtgcaaaatgacgcatggaatttcctccggactttattgaaatggcgcaagggcaacgatatcatcgctaagggcaagatgaaacatttcatggtgaaccaaggtgtctacgtgtacgagcgcagtctggatggccggagcgtattggtcttgatgaatggcagcgacaaggaggtgaacctcccgttggcccgctatgcggaagtattgcgaggtaaaacctccggaaaagagatattaaccggaaaggagattccattgggagacgaattatccttggcaccgaaagggatcttcgtactggaaatgtgatgccattagccccgatgatttttcattcgaagacctattcatagattactaataattaaatcgggaggccttaaacctcccgattttcttttcatatatactattttaatctcttttcaagaatcaatcgatgcctgcattgaatgccgttctcccagataggctcggcatagttccgcacgaaataatcacgatctacggctaccaaatcgaagccttcctgttgataaagcatcatcgggccggcggctgaggttccggtacaaatacgcaaaagctcgacatcttgagccggagcccatttattagatacatgccgtaatagtttccgggcgattcctcgccgacggaagatatccgccacggcaaggttcatgatctccgccttgccaccctcctccttgcgaaccacgatcacgccggcaacggaatttcgtaccgtagcgataaagcaatccgaatcctttaggtaagcctctactttctcccgatccggatcggcttccagcaataactcataaggagggaataaagctacttgtatctccggctccccgttagcgacgatctctactatatttccgtcaggatctcggattacaccctcatagtaaccatccccggaagtgcgggtctcaccggcgatcgtgtatccatccatccggaaacgttcgatcatttgatccacttgctccttcgtatccgcatgaaaggccagatgagccaagccgatatgatccttgtcgtaagcctcagtaatatcttgccgttgcatgatctccaaagcggggccactctcgaaagagacgaaataagaggcgaaccctttctttggattcacatatttctcgttactcttaccattgaaatactttacatagaaatcccgtaaacgttccagatgattcgtccacaaagcgatgtgtgttaattgcataagttggtggttttaatttgtcactgccaaagatataaaaaaatcagacatggttccctacattatcgtcgggataatccatgtctgattactgttttcttcttatttgcgattatttacaaatccggcaaccggcgcatttagccagttcaccgcggaaacgtttctctaccagtttatgcaaacggtctttcaacgcctccaagcgtacatggtcgatcacgtcggaagtgaaagccacgctcaataacatacgggcctcgtcacgcgggataccgcggctttgcatatagaacaaagcgttctcatctaactgaccggtcgtcataccgtgcgagcattttacatcatccgcataaatctccagttgcggcttgctatacatacgtgcctcacgggtagcgcacagattacggttcgtctggtaagcggcggtcttctgggcatcctctttcaccaagatacgtccgctgaagacacctacggcatgatcattcagtacgttcttgaacaactcgttgctggtacaattcgggaccgcgtgggtaatatggctataggtatccatctgttgctccttgtccagaacggacataccgcataaggtagactcggcatactcgccattcagttccacataataattgttgcgagtcaagccattcgtcaacgtaataccgtttatcaagacattggtcgaggccgcctgctttacgtgtacggaagagaaacgggtcgtagactcgctgctttcttccaaatcataataatcaaagcgagcaccttcctccgcaaaaatctcaaccacttgagtcgccaagaatttcacgtcgtcgatactatgatcgcaaaccaatagcttcgcttccgaatgaggttccataatcaccagaacacgacggttcgccatcgtatccacatcattacggaatatattcactaattggataggacgctcaactacgacatttttcggtacatacaccacgaaaccatcttgggctaacatcgtattcaacgcgataataccatccttgctactcggcgccgcctttccgtaatacttggaagcgatctccggatattgctccgtaaaagccttcaaccctccagcatacacgccttccggcaaatgcgctttcggtaagtccttatcgtaaaacgtatcgttcacgacaaagtataacgatgtgctcaggttcggcacgtcacaacggaacacgtcataaggattcaccgggatagcgacccggttgatattcaaaccgtaatccggagcgaacgcttgggctacatccgtatatttataatcctcgcttctcgtggaggggaatccgagtcgctcaaagttcgccaaggcatcagccctaagggcattcatcaccggcgtactatgacgacataccagatcctcacattgggcgaaaagatcgatatattgttgctcggccttcatattactcatctcccatctctttcttgatccagtcgtaacctttctcttccagttccaaggccaattccggaccggcggtcttcacgatacggcctttgtaaagcacatgaaccacatccggcttgatgtaatccagcagacgctgatagtgcgtgattacgatagcggcattctccggagtcctcaactggttcacgccatgcgctacgatacgcaaggcatcgatatccaaaccactatccgtctcatccaagatcgccaatttcggctctaacatcgccatttggaagatctcgttccgctttttctctccaccggagaaaccttcgttcacgctacggctggctagtttattatccagctcgacgatcgcacgcttctcacgcatcaatttcaagaagtccgtagccgaaaccggttctagaccgttatatttacggtgctcgttcaacgccgcacgcataaagttcaccatactaactcccgggatctcgaccggatattggaagctcaagaaaataccctcacggctacgatcctcgggagaaagatccagcagattcttaccgttgaagataacctctccttccgttacctcaaaagcgggattacctaccaatacactacttaacgtactttttccggaaccgttcggtcccatgatagcatgtacctcacccgctttcaccgacaggttgatacctttcaatatctctttgccatttacgttggcatgtaaattcttaacctctaacatcttttctaattgaaaattgaaagttgaaaattgaaaattattctatcctacgctgccttccagcgagatcgttagtaatttctgagcctcgacggcgaactccatcggtaacttattcattacctcacgggcatatccattcacgatcaaaccgacagcctcttctaccgagataccccgttgctggcagtagaacaattgctcctcgctgatcttactcgtcgtagcctcatgctccacgatcgccgtctcattctgaatatcagcgtaagggaacgtatgagctccacaagtagagcttagtaacaaactatcgcattggctatggttacgggcgccttccgcacgggcggacacctttaccaatccccgatagctattctggctatgaccggcagagatacccttggatacgatcgtacttttcgtattcttacccagatggatcatcttcgtacccgtatcggcctgttggtaattattggtcacggcaaccgagtaaaactcacctaccgagttatcacccgccaagatacagctcggatatttccaagtgatcgccgaaccggtctctacttgcgtccaagagatcttgctaccctcacctttgcacaaacctcgtttcgtcacgaagttatagataccgcctttaccttccttatcacccggataccagttctgtacggtagaatacttcacctcagcacgctcgttcgccacgatctccacgatagcggcatgcaattggttctcgtcacgcatcggcgccgtacatccttccagataacttacatacgcctcatcgtcagcgacaatcaaggtacgctcgaactgtccggtattagcggcattgatacggaaatacgtactcagctccatcgggcaacgtacgcccttcggtatataaacaaacgaaccgtccgagaacacggccgaattcaaggcggcgaagaaattatcacgataaccaaccacgctgcccaaatacttctgcaccaagtccggatgatgttgtacagcctcgctgaacgaacagaaaataatccccttctccgcgagattctccttgaaagtagtcttcacggaaacactatccatcacggcgtctaccgccattccgcttaaatgcttctgttcttccaaaggaatacccagtttatcgaatgttttcaacaactcaggatctacctcatccaagctctttggtccctcttttttcttaggggcggcataatagataatgtcctgataatcgatcggcgggatattcaagtgaggccatgtaggcatctccaacgtctgccaatggcgaaaagccttcaaacggaactcgagtaaccattccggctcgttcttcttggcagagataatacggaccgtctcctcgtctaatccacgatggatcacctccgtatcaatatcggtaacgaagccgtatttataatctccgctcgttacctcattaattatatgatttgaatcctgcataattaaaaattaaccattgataaaagcccttcattctcctaatgaaaacaaattatgtgggaaaattgttggtactatttgcttcacgctataataaaaacgagattctatctttgattgacgatgaatcaagaccgatccacgatccacgaactccagcgcgttcaacagcaaactggtaaagaccaaaacgaccagcaacccgaaaaaaccaccaaacaaatggttgataacgctcaacggtgtcgcccctaccaccttggtaaccagttcacccgctaggataaatacccccataatcaagataaaacccgctatataactcaagatcgtaaccccttcttccggaaaccaacccaacgccaagatatatcctttcagccaagccgccgcttttccgcagaaaaagatcgcgatcactagggctataagcgaaacaacctgtttgatgattccatcaaacaggcctttcacaaatcctatccctgccagacatagcaatgtaatgtccaaccagttcatcgttataacgtcttcttaatttctgtctcttcgtaagcctcgatcatatcgcccacttggatatcgttgaagttcgtaatattcaaaccgcaatccaagccagccacgacctctttcgcatcgtccttgaaacgtttcaaagagcctagctcgccggcataaatcacgataccgtcacgtatcaagcggatcttgttcgtacgcttgatcttgccttccttaaccatacatccggcaaccgtaccgaccttggtgatcttgaatacctgctgaacttccacataagcggtaatctcctccttgatctccggagaaagcatgccttccatagcgctcttcacctcctcgatcgcatcgtagatgatagagtacaaacggatctctacaccttccttctcggcgtttctacgtgcttgcaaagacggacgaacttggaatccgataatgatagcgttcgaagccgctgccaaaaccacatccgactcggaaatctgaccaaccgccttatgaattacattcacctgaatctcctcggtagacaaacggatcaaggagtcggacaaagcctctacggagccatccacgtcacccttcacgatcacgttcaactcttggaagttacccacggcgatacgacgtccgatatcatccaaggtaagcatcttctgcgtacgaagacctaactcacgctgcaattgctcacgacggttagcgatctcacgcgcctcttgctcagtctccaatacattaaatgtatcaccggcctgaggagcaccgttcaaaccgaggatcaataccggctcggaaggaccagccttctccacccgttgattacgctcgttgaacatcgctttgatacgtccttgatgagttcccgccaaaacgatatctcccatcttcaacgtaccgttctccaccaatatggtagatacatagccacgtcccttgtccaaagaagactcgatgatagaaccaaccgcacgttttttcggattcgctttcaaatccaacaggtcggcctccaacagtaccttctccaacaactcctcgacaccgatacctttcttagcggagatctcttgactctggtacttacccccccagtcttccaccaagtaattcatattcgccaactcctccttgatcttctcaggattagcatgtggcttatcgattttattaatagcgaaaacaataggaacaccggcagccgaagcgtgattaatcgcctcaatcgtctgaggcatcacgttatcatcagcggccacgataataatcgcgatatccgtcaccttcgcgccacgggcacgcatagcggtaaacgcctcatgacccggagtatccaagaacgtgatacggcggccattctgcaacttcacgttgtaggctccgatatgctgcgtgataccaccagcctcaccagcgattacgttcgcgctacggatattatccaataaagaagtcttaccatggtcaacgtgtcccatcaccgttacgataggcggacgggctacccaatcctcctcgttatcatcttcctcatcagcgttgatcgcctcgacaacatccgcgcttacatattcagtcttataaccgaactcctcagccacgatattgatcgtctccgcatccaggcgctgattgatcgaaaccataaggccgatgctcatgcaagtaccgataacctccgttacagatacgtccatcatgttcgccaagtcgttggccgtaacgaactcggtcagcttcaataccttgctttccagttcttcctgttccatcaactcgtgctcacgtttcacagcggcgtcacgtttatcacgacggtatttagcccccttattattcttattattcttgttggtcaagcgagccaaagtctccttgatctgcttttgaacatcctcttcgctaacttccgctttcaccggcttcttcaagcgaggcttacggtcgttattcggacgatcgtcacgattcgggcgcagataattcgtacccggcgtattattcacgtctactcgatctttcttgatacgtttacgcttcttcttagcgtcaccttcctcacccggtttagcaggagcgttcggtttaatcaaagtaggcgaattcggactcttatgaggagcgcccggaccgttgctattattacccggccgattgttattaaacttttgcttctcatcacgctctttccgcttctcctccttcgttttcttcttcggacgagtcgattggttaagcgcatccaagtcaatcttaccggttaccttgatctttgattccaatttaaccgagttcaaacggaaaagattatcgtctttttcctcggtcttctctacttcctgttccggtttcacactttccaccttaggttccgcaacaaccggttgcttctctacggttttttctttttccacttccactactataactttttcttcttttttctccgtgggagcctgcgcaggctgcgcgggtttaacaggagcttgagcagcgggagcggcaggcgcttccttcactttcggctcttcctttaccttaggctcttctttcaccttcggctcctctttagccttcggctcttcctgctgttttttatgttgtccaccatccaaatcgatatgacccttcattacgatcttaggcctgaattcttccggtatcactgtctttatttccgcagtcttctcttctttcacagaaggagcctctttctgcgcacgatccgccgcaaaattacgatctttctcaggcagatcctttccaaactcttttacgagcaaagcatactgttcatcactgatcctcgtgttgggattatcctcaaccgagaacccattccggtgcaggaactcaaccaccgtgttgattcccacgttcaattttctctgtacttgaattaattttataggcatatctaactttgtcgtaatacttattcgttaccttcatcttcaaattccgcggataagatagctaaaagatcgtccacggtctgctcttccagatcggcacgttcaataatctcattgcggttcatagcaaggacgctcttcgccgtatagcatcctatattcttcagtgcgtcgatcacccagctgtcgatctcgtcggagaactcatccaagtagatatcctcctcgtccgctccttcgatatcacggaatacgtcaatcgtatactcagtcaacatacaagccaacttaatattcagaccgcccttaccgatcgctaaagagacctcctcaggacgtagataaacctcagctttcttttcttcctcatttacacggatagaagagatcttagccgggcttaaagcacgctggataaacaaagagagatttgaggtgtaattaatcacatcaatgttctcgtttctcaactcgcgaacgattccgtgaatacgagagcctttcatacctacgcaagcacccaccgggtcaatacggtcatcgtatgactcgacagccactttggcacgctctcccgggatacgggcgatcgccttgatcgtaatcaagccgtcattaatctccggaacctccaactcaaacaaccgttgcaagaagaccttatccgtacgggaaagaaggatcttcgggttgttattatagttatccacacgttgaacgatcgcacgtacggtctctcccttacgatagaaatcggtcgggatttgctcggatttcggcagtagcaactcattaccatcgtcatccagcaacaggatttctttcttccacacctgataaacctcagcggcgatgatgtggccgattttatccttatacttagcgtacaagctgtctttctgcaattcaagtatctttgaagccaaagtttggcgcaagtttaagatcgcacggcgtccgaagtctgcaaaatgcacctcgtcggtcacttcctcgcccacctcacagtcggcatcgattttacgggcctccgtcaacgtaagctgcaagttctcatcctccaattcatcatcagccacaaccgtacggtttctccagatctcgaaatcacctttctcagggttgataatcacgtcatagttctcatccgtgccaaacatcttggcgatcacgttacggaacgaatcttccaaaacgctaatcatcgtatctttatcgatattcttcaactccttgaactccgcaagggtgtcaatcatactgattgtttcctctttcttggccataatcttacttgaatcttattaagtattttgtatattttatttcatcaaatgtatacgactcatcctccaccacagtcaccttccgcttagcgccttccggtttcaccttcttctcgacagagacaaccacaccgttctcgtcggcagatttcaacacaccggtcagcttcgagccgtttttcaacagcatctccacctcgtttccgatgttcttgacgtattggcgaagtaccttgaaaggagaagtaatgccggcggagccaacctccagctcataatcctcgacgtcacgatccagatgctcctccaaataccggctcaactcagcgcaatcatcaatgcttaccgcttcatcgttatcaatttcaacgactatcaggtttcccggtttaatcaccacgtctactaaataattgcttgaagaggctagtttttcctctattaattggcttaccactttcttttctatcatacacatatctgttaagaacaaaagaaggggactacccgccccctcctcaacttcacttaatcgcccgcaaatatacaaaaaatcaatgagttctcaaaatatcctcatctttttacagaaaaaattaatacgacacaaaccggattactatccatagtaatcagaattaatatctatagaaatccgatttactattgacagtaatatttattaacacttttatgcctatctttgctgccgaatacgaaggggtgctcgcaaaatccttcacgaaaggagcgggctgagatcatacccatagaacctgtacaggtaatgctgtcgtagggattcatgcttctccgatcctttctattcatctatttagttttaaagcaaaaagatgaaaagatgaaaaatgtattggttatcttggccggctccttactggctacaaccgtcaaggcacaaatgcccagtccggtcgactccttgaaaatctcaaaagacgtatctttggatgaagtagttattaccgctaccaaagtcgggaaagaaaccccggtagcttatagcgacatctccaaacaagagctaagcagccggaacaacgggcaaggtatcccattccttatctcccaatccccgtctgttatcatgacctcggatgccggaacaggtataggttactccggttttcgtatccgggggacagacgcgaaccgtatcaatatcacgatcaatggcgtaccggttaatgactccgagtctcataccgtattctgggctaatatggccgatatagcctcctcggtagaatcgatccagatccaacgaggtgccggaacctctacgaacggagccgcggcttttggcgctacggtcgccatgcaaaccgagaaaccgtccttaaagccttacggcgaatattccgtatcagcaggttctttcggtacgctgaagcatacggtaaaaggcggtaccggattactttacgatcatttcgctttcgacgcccgctactccaatatccgtagcgacggctttatcgatcgtgcctccgcccgtatgagctcttactatgcctccgccgctttctatgccgataatacattgattaaattccaagccttcgggaacagcgagaagacctatcaagcatggaacggtgttccgtcttatttacttgacacagatcgtagctataatccatgcggagaatatgaggaagatggagtgaagaagttttataacaatcagacggataattattggcaacacaactaccatttaatggccagccagcgtatcggagatttctggaatatgaacctgacccttcattacaccgatggtaacggatattacgaggattataaatcgaaagccaaattcagcagttataagctaccggaatatatcgatccggagggtaataccgtaaaaaagaccgacctcgtgcgccgtaaatggctcgacaattatttctatgggaccgtttatagcgcgaactatcaacgtgacaatacccgccttacgctgggaaccgccgtcaacaactatgtaggcgaccattttggccgggtaatgtggaccaaaagcgcaaacgtcttgccacaaccggattacgaatattaccgcaataccggtaagaaattagactacaacgcatacgcaaaattgacccaacgtctttcccctcttttcaccggctatctggacttacaataccgtgggatccattacaccattaagggaaacgatgacaaagccgaggaagagctggacattcataagaactggaacttcttcaacccgaaagccggtataaacttccataataacggccataacgcattcgtctctttctccgtcgcaaatcgggaaccgaaccgtgacaatttcacggaggcaggccccgaggaacgtcctacccacgagaccttatatgattacgaggccggttatagttttggtaacgaccgtttccggtttggagccaatctctatttcatggattacaacaaccaattgatcctgaccggcaagatcagcgagatcggcgaggccctcacttccaatataaaggatagctaccgaatgggtatcgagcttaccggaggtgtacaaatcacctcttggctgaattggagcgcgaacgtaaccctcagccaaaataaaatcaagcatttcgtggaatacgtggataattgggataccggaggacaagagatcaatgatctaggcacaacgaatatagctttctcacccaatctaatagcgaacagcatgttcgatttcgtttacaaagggtttatcgcgagtttcaactcacaaatagtaggccgccaatacatagacaattcaagcagcaaggatcgttccatcgatccctactttatcaatagcctacgtatcggttacgccttccagcctaagttcatgaaagaaataaccctagacgtgactatcaacaacctcttcaacgagaagtacgagaccaacgcatgggtatactcgtatatcgaaaacggcacacgtaaaaaggatgacggttatttcacccaagccggcacgaacgccatggccaggatcaccttcaaattctaacttaattttcaattatcaattatcaattactaaaatggtttggctagaatacttcggagtaataaccggtctgctctatctctttctagagattaaacaacataaggccatgtgggtggtgggattcctcacctccctcgtgtatgtctttgtcttcctgtccgctaagatttatgcggacatgggattgcaaacctattacgtaggaatcagcatatacggtttctatcaatggacccggaagaaacatgagatacacacggaaaacgacagtcttccctccgaccgtatcctatacacccatctgagccttccgcttttcgtggggattatcgggacattggccgttgtattcgccatcttatggtatctccttcatcaattcacggactctcccatccccgtaggcgatgcgttcaccacgtcggtaggcattgtcgctacttggatgctggcaaggcgaattatcgagcattggattttttgggtaatcgtaaacctcgtttccgtatatctttattaccttcggggcttgtatccaacgatgctactctatttttgctatgcgacactagccattgtgggctattacaattggcggaagaaaggggaagagttttaatttataatttatgaattatgggagataatacggaagtgaaggaaagaggatgtgtgatcgtagcgaatgggagatttccttccgctgagttacccttgagattattaaaggaagcgaaaacgattatcgcttgtgatggagccgtgaagacactttatgaaaagggtattcatccggacgctatcgtaggagacttggacagtatacccgccgacctgcgcaaacgctacgcagaccgaatccaccatgtagaggaccaagagatcaacgacctctccaaatccatccgcttcgcccatgcccaaggctatcgagaagttctcatattaggagctaccggattgcgtgaggatcatacattgggaaatatatcccttcttatggagtatgcccccttattcaagcgggtggagatgttatccgactatggtcttttcacacctatcttagaaacaacgactttcgcttcttatccggggcaacaaatctccattttcgttctttatcccgaaggggagattagtacagaaggactccgctggcccatttgccaacgaaagctcacctcatggtggcaaggaactctcaacgaggctttaggaaatcaatttaccgtcaccctctccccagattgccgggtgatcatttacagggaagctccccatacaaaaaaatagtcctgaaaagtatcactacttttcaggaccgttacacccctcaactttacatgcttaaataagaagcgttcgcttccttatcaagcagataatttttttaactcattctctttccattcggaaaaaccttctaccctatcccttatctggaactgtagcttatcgtcggcaaccaacttcagcacagccgtgggagaaagcggcaaatacatatcattcacggcgaaaaaagctttcagcaagaccacgtcatagtcgtcgtggattacttctttctttaatacaaccggcacctccatctgagtcagatagtaggctgaacgttcgtatgcacaccaagcatctccttccagatacagatagacattgtttggattatctacctcatgaggcagaaccaactctactacatctgatgcttgttccatataaaagaaattattattaatatttgtcttcatgacttttacaaattaagtgccttctgccctatacctagggaggaatagctatcattttacagcgttgaaactatcaaataccgcattatcctctattttcttgcgcaattcctctaaatttatcgccgcggcctttacgcccatatcctgagcctgcttcaatagagattccgcttccgtcaaatcaccggtcaacatacttaacactcctttcgcgtgaaccgcctccggggcgttccccgctttcgccaaatagttcttagcggaagcataatcacccttgcccatagcgatattcgcggcgttaagattcgctaccggatcattcggaaacatacggacagcgatatcaaatacattattatattcgtcactaccgatctcatagctgttagccaccgcgaacatctcccctaaacttagctgttgcggacgagtcttgataatctcacgcccctcatccaccgtaaactcacgtaccgtataatcaatcttatattccgagcgacgtaacgaagggaaaatatctttcagcacataacggaaagcggcgccaccacccaaggcacgtaacttagcctccttgcgatccggatcatccgagctatcgataatcgccaatacctcgctacgattcggtacattcggatcggcctctaccttttccttaaaaccgacccaatcttccggttccgagctcatcgtgaagaaatcagccttgaagtcattcttctggcggatatagtcacgtaacgctttgacacgattatccgccaatttcttattactagcgtaagagccttccggtgaggcatatcctttcagtacgatacctgtcggtttcacgttcttatcctctgtaacggtacggatcgtattattgatcttcgccaactccaccgcattattacggaaatcaggaagaatctgatatttacccacttggaagtctaagaaagccgtaccgacctccgcacgatgcttctccgtctctgccatcggcgtgatataagagaatgtaggctgaacctcatagcgcttatccggacgacgacgaatcttgtcagcgatcaataacggactaccggcctcttccttaccacaaccgcatagattcgggtctaacacgacacgtgcgtctttcatccaatcctcaaaaggcacggcggttttataacttaccacttgatcttccttcccggctttcaagatagtataatgaggtacgtcgttcaaattatccaaggcgacctcacggttatatactttctggcggatacgtccgttcaccaaaatagaaggaagcccctctttttgcgaagccgattccaagacgggggtcagttccaaatagctacgggatttcaccgcatcgccacttaccgtcaccacggcatcgatatataccgaatcgcccttctgtaccacgtcgttacaaatcactttaaccccatccgaggcagtctgtcccatgattgccggagacatgacggccatcatagccgccatcatatatgcatttatcttcttgttcatcgcttgggtcatttaataaagtaaataatagaaatagccgctttcgtaaccccgaaataatctttcgtatcgcttttcaatacggttccgcaagtggcacaaggatatttatcataatccagatgcgcccaaccaatacccagcacggcttccatgctccaccggtcgctcaacaaccactgatagccataagaaagtccggctccatacaaattaccttgataccgatgattctccatattcttgctcaagaacttcagacctccaacattgtaatccgcatagtgcgcatgcaagccgaagaaatgtccgttgaacttctcacacaaccaataacgagcttctggttgtaccagccaatgtttcatacgagcctcatcgcccaacttccatccattatagttaccggatagatctagcgaccactttttcgccaagccaacctctacgcccaagttgatcgtagcagtcgcatcatagagcaagttcgacttcaccgcgaacttctggccgtaaacgcctgtcgtagctaccaagagcaggactaggaaaagaattctcttcatatcgaatattttttcgtttttattatacatacgtgaatgccttcacttcgacgagctcgcattcaaccgtttaagtaataacttaccaggcttaaacttcacgcttttacgagctcttatcatataagccactccattcttaggatttctgccgatccgttcggattgttcccaagcggagaacgtcccaaagcccaatagcatcaaagaaccatcactttccaaagcctctgtcgtagtctcttcccaagcctgaataaaccgcatcgcctctacttgtgtaaccgacaatttatcagccaatgttttcacgagttctctcctattcatccctttcacttttaatttgtatcacaaaaatagattataacatttcttagcacgataggtgtgagtttcaactttaaagggtaaacctaccaactatccttgattgataagaacacctattcatttcaaagaaggtgataggaacaccgacactttataaagacagcaaggggcagacttgtgtaagcctgccccttatcagtcatactgtatttatcagactcggattctattaacaccatcaatccgcatcatccacttctaattcttaatctcctccttgcggataaggttctcaaggtcattcacttcctccaaggaaaaccccgtagattgggcgatcacagccggatccgcccaaaagtcttacctgtttgctcgtttgccagaaccacgtccgttcgccatgaagggaactcgggaaggctgaagttcagaaaacgtatctatgtcgtaaaggtaaggactattttccgaataaaaaatctcgtttagataaaataagccattcatatcactttagtatcaaagatcaacctgttagccaaacggacattatctgatccttttgatcaatataagacgcatatcgtggcattcccttttaacgaaagccacacaataaagacatggagcgccgctttattcatgttttaggataaaaaaggacggttttcaacgcacattaggaggcaaaagcctacacatacggtggcgttgggcaacacctaccgtgccgttgggcatcgtaagcggtcgctaatagggttataagcggtcgtgaatgggcattcttgtaccgttacaccccagtcgtaagcctgtttttccccttttcaccctacttgatatgaattacgatgaactaatttagctagaatgaatgggcgtttttcagcatctacgtatatgctaagcaattactgtttttttcttgcgtatttggaggcaagccgtaggtcgggacggaaaaagggattctccgggagttaagaatacaaagtgtcagattgatttctgttaaatagagagagacgcagcatgctgcgtctctacaactagatatatcaatttatttttcactcctcacacaacgaacaaacatgccgttattcgtatttaatgttccgacattaataggaacattggtattcagagaataccaaaaatctataaaaagcatattcgtatcagcattagagtcaccagatccagaccaataaaaagccccatatcgatgggctgtattatagagaagtcgacctccacccaaatacccaataccaatctcatcaatccctgtatcctctgcagcactcccatgctcagtcataacagcctttccataagagaagaacaaattgacaggttctccagtagaacgaaccattaatgtccctttagccggattgcaatctatagtttcatctataaccgcattgccttctgaatcccactgccaaccaaaaggagtattctcaaccggacaactatcatcatacacatatcctccatatgtaaataatgtatttttctccgtagcactcttaatagcactgtaatggctagccgcaggaactttataaccactcggacatggaccttgtccatactcccatttgtatttttcattgcgcatgtcctccgatgttttttctttccaattcaaatgcttattaccataagtcacatcccatggtgtataataggaatctgaagcccctccttgataaaaatatccagattgggtcggagcgttggtgatagagccttttgtcgtacaattgaataaagaccaagttgccccaccatccaacaattgcgtatccgcataaccttgacgcaaataaatcatatgctcgcaacggttattatgataggttaccttgatagcgccataacgattggtggaagaacttcctgtgctcgaattcggtttataattaaaaacaatatcacctccagtacctgtaacagacttcgatgttccgacgacagactgtccgtcatctgtagatagcgtaaaccaatccccagcggtaatagtagctgtccaagggccaatagaattcaatatctcatactttctcttctccttattaaattctcgcaccttaactttgacaagctccctgttgtcccatttcttatagaaagctatcggatcgaccaaacggataacttgattgacagttacagttttagagattgattttccgtccttccctgtagccgtaatcgtcacggtattagttatgtgatccttactactaatattcgttttcttcgtgataactcgaatcgtattcgtatttttatcatacgcaccaatctggaaatcctcacgatttgaaccttccacactccatgtacaattatcaaaccaaccatggtctgtcggcaacttcacttggatatcacttatagagcctatccgatacccgatataaatatcatccaccgtaaaatcccagttaaaatctttcgtcacacgccaagaagcctcgtcaaccccgcccttaccggtaagattaagcgtcacgttatagtgggcgtttcgctctaccgcaaaattggtaaaagcgtcatctcctaagaaaaagcgataaacaatcttcccactagcacccatttctgaatactccgcttccacacgaatataagaacaagtcttatctgcttccacagtggcaacatcctttattggggtgttacctaaactggccggggttttatatgcctctacatactttccgtctttcagtaagcagacaccatccggttgcttattctcatacataaagaaaacactgttatctttcattgaactaacattctctaccggattggaaaattcgatcatatcagcctccgttatataatctgaaggtgacggatttgccgggattaagttgttcataaacaatttaccagtagccggtacttgatgcaaagatacttttaggggcttgatcgtacgatctttcaatccagaagtattcacagatacggatatcatagcgtaaatacgctttaacgaaaggatggcaaaaccttttcctccgctaactgatacatcatcagcggatgcgctcattaccatctttggcaaattatctaacgttccatacgatagattatctatcttatcgaacggatccgcactcaaatcagattctgcgttcgcaattactcgtacacgataagaaccattctgtaaagctatatcgtaattaaccgccttattctcttcgttattatttacggtaaggccattcaaggctgcaccggtcaaatacaatcctttaactaagcgattattatccttattatacacaaggatattcaaatcgctaatagcattagcatcagtagctgaggctttcgtgagcggagagatcacgtcgctagcggaaacgctcaaggacagtcgtaatccatcaacattctgctctcctccattcacttccgtctcttccatgcaggaacctagtcctagcattaacaggcccaagaacaaggcatatatattttttatcgctttcataatattctatttactgtttaattaaagtttgcgctaacatctttcccaacccaaggagctacccatatattaaactcacctgttgattgtttcaacattcctgtcacatgataatagttaccgtggatcaaaccgtccgtgcattcatccgctacgaaaaccggattgataggaatggaatatttgtaatccgtaccctcacctccggaggtgatctcctcactggagctaggctcaccctcaagctccaaatcatcttgatatagataaaactccgaactcccatctccccatcctgaaccgttttcccaataaggatgcaagaaatttcctttcatcttataaatatatttctttatatccgcacccaacgcaaactcaccgaccagattgactgtcagagcattctgcaaatcggcgactttctctctctcatacgtataaagaacaacctctacagtggagcacgctttatttattgtttttagttggctgtcaagtaatttagacaagagatttttctcgttctcggatataatcaagtttgattctgtattcacattcagaatctgaattgttttcaagctaaagagccatttaggagtcgtctctattttctcaactgttattcccccctctaacgttatcgttagatgagcacatttgtcgccaatcgttgtgcccacgttacatcctacatgcgaacaaccatttccattcatagccttcgctatttctacagcccccgccggaattctaccatttttgcctacagcaccaagcttcccatccaacttataaatggtgacagcattactgctatttgaagcactgttcattaactctttagtcagcacggctgttaattccgtcaaagcaaaacctcccagattccaatcactcgttgtcgtagaaccttccagctccggcaaatctacctctagctccagatgtaccttcgccgccagttgttttaggctaaccgtcttaccccccgtaaccgatccatttgttaactcaaacgtcatcacattctctcctacctttatcaaggttttaggatcgaatgtataataatcggttccccctaaagatgtatatgatacggattcttcacataatgtcgcatagtccatttccgcataagacgcaaccttgttttccaatggattcacgatagctaccaccttcagttccgtgttaagcggtaaggtcaaaccggtcaatttaaaggagcccgagctttgcgtccctacaaaactaccatcacctaaggttccggtcttagaaatcaagtatttccactcgttatctaccttcttgaagatagagacaaaaatattgtttatgttaagttcatccgccgtagcgtactgataagtaccatcggcatttatcactttcgtctccacgccctcagttgagaaagagatcgaaaccgtacctgtttccatcggtcgctcatctatcagcttctcttccgtacatgcggtaaaggccaagagcgccaaaaatcctgtcaatactatatcttttaactgcttcatgttatgtttattttaccctgtttacttaactggttctccaaaaatatcaccgacactcaaggtattcggtatccaatcttcaattacaaaatcaatatcctcgctggcattacctattgtcacagataacttatagagattccccccaacaaccttcacctcatctcccggctttgtcttgatcggataggtacgatccattaccgcaccatcgaccttataggttattttcatggaagtctgacgatctgcatccgtattatcatagccataaaaacggatcttatcgtaagtaccgtaaatgtcattcttcggatcactctggttcacatcggttggcttcagaatattatcttttaccgtggaaaaagagttaccatactcacctaccactttagcgcttagcttaatgttcagcatctgtacggaaacgacctctacattcggtactaccggatattcaccacccaccttttctttacttgtgtctaccaccttgaaggaagccagttcaaacgccgcgactctctgcgatacgggaattgttattttgttacaattcacgtcatcgtgagtagccaattgagtagttgttttataagatccaatgggttgttctcctacttttactagaaaattaggttctgccaactctacatctcgaatacccgctatggttgtacaagccaataacttatcggcagtcgtctgtgtcaggttcgccaccgcataagccgtaagtgccggcttatcacttggcactttcacgatcatgtggcgctcgatatccgtagtaaaggactcgctactcgtctgtaaatcgctcgttgcgtaccaataagaagacaatacattgccatctttaataatagctacaaaacaattactgatagaagattccgtagaagtaacatcattgggattttccgttatttcaccagccttggtcatagagctattgccggaaagagagaaggcaaaaactgcctcggtgtttgcgatattcgtcccaacgtctcccatatccacgttattcaaaatatcgtcttccatggagcaggacactccgatacaaaggaagcataataatgctagtatattctttattttcataatggattgaatttttctcttgtttttacgctagcaaaattagaggaatccattattcggcacgataggcgtaactttcaactttaaggggtaaaactagcatattggaagtagcgttttaagggtgtggctaaagctatcttaggcgatagggatacctatgcagggcgcaaatccatccatcataggacaaaaaaacggagttcggaaattccgaaccccgcctttcgctgtttatttaaatataaaagaacttaatcaattcacgtcatcctctgtttgcgtgatgactgtccaaggctgcacctttacgctaaagctgacgcaagcgttcaactcgctagtatcgggatccttggaaccctcgccggtaatagtggcatataccttatatatattattgcgttgtacgcctatagcagcaccatcgctaatagggatacggtaataacggttctctttgaccactccattatttgtccaagtccctttaaggatcaacagggtttggatatttccggtaggagcatcgctaggctctggatcttttgtcatgtcgtgtgttgttccattatactcatatacgtaaaattgagccatttccggaagactgctgttatttgtaccggaggttgtcttatcagagaacgtttgccatgcgggtccggaataattgacctcactgccactcatgttcttactgtgattattacttaccatgtttatagaaacctgctccttgatctctttggcaaactgagcgacattgtttgtacccttcaccaagtaataatcatcacgtatataatcacatccatggctgaaagggccggcggcttgctccaatgagtaagccgtagcgtcaccatacaatttagacttagtactaacattcgctacgtatacgcctgtcaatgtaaatgtagcaccttcataactctgcgtgaaattgcaatccaatccctctaactgcacccgggctacatggcgggttaaggaaatattatcagtcgagttctcctcaggataataagcatcaccctcagtccatttgtcgccgtttttaatgattgtcgtatgattggagcctatatcagcttgttttgtattcttaatagactgatcattagctattacccaattatcgtaatccgtcccagccacaagcccaccgattgtgacaatctggctaaacatcgggacataagtagcttgagttgacgcatgtacatccgcaaaacttacgatattcgaaagctcgccgttcgttatatccccccatgtagaaggaattttatcaagcgctgtattcgcgaagatcaccactttcaattgcgtagaagaaacttcacctgccgccatagccttcactttaacaacgatatcttcaatcgttcgcaacttttcagagccggaagcctccactgttttcatggccgcaaatttatcgttagccgcatcaccgtcattatccgcataaaataaataagcggtcaggctccttataaattgctcgtttccactgcctacttccgttgtcgcttttgtctgtatcccatccaaagccgtagcggtaagagagacgttcgcgtctatcatctgatagttctcttccggtatctcgatgccattcgagctatcgtccgagcaggaggcgaaagtgcatgcggcgaaggaggctaataataaatgtcttagtttcatatccttttgttttttcttgtttatactaaatttcattccctatgattccattacttagtctattaccggatgttgcattaccgggccccagcctactacctgcacggctatattcaagttggtatctacctcgggttccggatccgggcccgggtctggcgttacgggaatattgtcgaaactttcgccgtcaaaataaatacggagacggtaaacgtagttgcgacggatgaaattatgatcatagccgttctgcaagccacccgcattgatcaccgccgtgaagattttcgtatggtcctgataactggaatttccccgtaaggtagcttttacggcgatcatcgtgtgatcgtcgcttttcatattttccattacataatgaacgaatggcgtattggatatcgaagcgccatcatttaccaacagatcctcgaacgaggtattttccgaatttcgcacggcatcgggagcctctgtctctccccaatccgcctcactgaaatagtaagactttgtcttcatattgtagatacctaccgcatcgattcgcacctcacgtccggcgaacggcgttccggcaaaacgagtggatatatccaccaaatcaatacgtgcggctacacgggtcaaaaggatcgggtcggagatgccatccacattctgatcgccaagatccgtatatcctaaatagttatcttcctcagataaagtggattttgtaacgatcacttgactactcatcgttaggttcgtttgcgattgcgaggagaggtctaccaagcgagtctggaactcatcgtatgtagaaacggtagataataaatctctcggtacgttcgccaagacaatgatccgtgcccggacagccttcgttgtcggcacatcggctattatggcggaatgttccgccccggaaagagcctcccatttataaccgagcagttccgtgccggtctcattaaatactaccactgccaaattattgatataagcctcaccctccaactcattcacgtcattgggattataggctttcgtagccgtaccggacgccttgacagtgacggacagcttagcgccttctaagggaagaaccggatcctcatctttagaacaactcacacaagcgagaatcgccaaaccggataaaaatatgttcgctaataatttcatgttcgtatcgtatttcttaattatatatgatgaggtaccctttaatgcatcggaatatcttcttccactactccccaaggacgaacggttgcccggacggataaggttccgccctcaccccattcaaggatcagatgggtattctctcccgcactcgtataaataggatcaccattctcgtctaccttggccgagcctaacgagactccattggcgcttatcgacacagccatatcctgtcccggacaagcggtttgcatagtaggggttatccattcaaccccggactcgttccacgcaccttccggattataatatacgctatcgccaatctgcgtgccacggtaatcaaaaccacttaatgtattattcaagtagaaatcgcaatccacggaacttctcaaccccatcctgccgagttgctcttgcaaccctcgggtctcgatcgtgaccgtacccactttcggacgaatcacgatctcagtctccttcgctacgcctccggcttttgtcaacacttgttcgctaccataataaaggctgtccggggtaaccgccaaaccatcttggcttttcaacatcactttcaagtcctctatggtctgggcctccgatacggattgcttttcacccaaggcattcacgttgccccatgccacgatacgtagactacgatcggcggtatagccatccaaaacgatctcattgcgggaacggataaagttcttatccaagctacgtttctccaagtaattcagattctcgtcgaatatatacagatcggtagattccatccatccgtattccgttatatcgtctcccttgatattctcgaccttcagtttgagcgtatagcactgatccaaatcctccttgatgcagctagtcgctataatagcgaacaaagccacaaccgagagaagcaatttctttgtaaacagtatgtgtttcataatcctaattttttcttatcaattattttaccctatattgttttattctacttcctcatggatagtcttcacgttccatggctccactttcacggatgcgctcacattggcggagatcatcggatcgtatgggatctcggaaccggggccgatgatggttaaggagatcgcgtatttgtagttacgcctaacatagaagctttcttcttttttcccgtcaatcgtaacttccgctcctacaggtatcgcataataacaattttcttttttcacataattagtttcagtatcagccaaaccattcggcagataggtataatctccttttacgatcaataaggtgtggttggcgtaatcccggttcgcggaagctttgtccgcttcagcgatctctcccaatttattttcatagacatagaattcatgattcaaggctgtattgtcttttgtatgagcctttgctaattcatctctttttgtctgagttccttttttataagaaccctcgtcgatattcggagatcctgagaattctttacctaccatataatttgaatatccaaaacctgtgtttgtaaagtcaaatgttttctctattcccccccaattggatgcggaagctacgcaggaaacacccttcgcactggcgataaagacttcttttaaaacaaagtctttacttatataattcgcattattaagattgtcgatctctgcagaagccaaagcgatcgaagcgacatcgcggactaatcgaaccgggcctgctccataaatttctttaccggcttgaccccctacggttatatcatcgccttgcttcgtactataaccaatacaattagtcgtattcgcaaccaaagttactgtaagcacctcgctgctcatagtcaaaccttttttcagagtttcctcctccagcttaatcaccgtagcaagaaacgcgtctttcgtaccggcattggccaacgctgcctgaacatttgccgaagcattggccacgacaacaacttccgccgcacccgcatatacctctttcggaccgatttcttgcgtggtcacatctgtacttgtagaggtcgttatgtcctcaccgctcaccgtatataccatactccaacccgtaccgaacaccccgaccgtaagcgtattcacgtctgcgtccgtaggagtagcctcctctcccgccttcgtcatcgcacccttctcgctcttgatcgccaaggccagttgcgctttctccagtaccggcgcttccggaatctctatcgtgttatcgtccgaacaagcgaccagaccacataacaccaacgataaaagaatatatctcttgaatctcatagtataatatttttttatttccacatttaatatgtggcaaaaataggaaggatatatcgtggcgctgataggcagaactctctataataagagacaaatgtatcaatttcataaaagtgataggtttccctaccttttgcaactttcacctatagaaaaaggctcaatccgtgtattttatgctaccggggtggtactcggatcatcctagtaacaaatatacataatcacttaaattcagcaaaatcatggcaagaaaaaagcaagacccatttccatgcagggatcaccttgatctccttgccttctctattgaatgtattttcctcgtctttcgtgataatgataagattctcgcatccggtcaccgaggcggcttccagcaagcctttgatttccctttctctcgtactcgcatccaccatatcccaagtaacctgtatgagttgtatcacgttatcctcccgttgaagcacaaaatcgcactcacaatttccttgatagtaggtaatcttgtccgaagggagccgcatccggttcagttgcataaacacggtgttttccagatttttcccattgtcgttgctctgcggcataagcacggcaccacgcataccgttatctatacagtagtatttatcaagcgatttctgttcctttaccagcgaacggtcgtatttggagattcgtgcgaacatgaagatgttacagatataatcagcccaaagatacaggtcatccttactgactttaagcccttgggacttgatgtccttgtagatggcattgatggaggtaggcttggtgagattggccatgacacgcttgacgaaataccgtaccacacccgtattggatatcttgtaatgttcggccaagtccttcaatatcatcgtgtcgaaatagccgtgaagcagtttcaactgctccgaccgggatgacgtcaatacgatttcgggaaaagcgcttgcctgattgtatgcctcgaaagccatcttcaatcttgccctgtcctgttccaaatagctattagtggcgattcccttgaaacggcaatattcattgaacgaaagcggataggtctcgtattccaagggatatccgcgcagagccgaacttaactctgtggacagcatggtagcattgcttccgcacacataaatgttcttacaataagatttatagacacgcaagacgaagtattcccaatccttaatcaattgaatctcgtcgaaaaacatatacacatcttttatgggtatatccggaaacatctccatgtatgaaactatcacatcatccaaatcatcggatgacatatttttcaaacgctcatcatcaaaccctagccataatatatttctaggggaaaccccttcacggacaagcccattgatagcgatctccattaatgtggacttaccgcaacgacgcacacccggaaccgtaatgatcttgtttcggttgatcggtaactttatgtctcgctcaatcacatcaaacggaatttcgctttgcttgatggcaataagagatttgatgacatctttcctcatgattttctttttttataggacaaagataggatttatttcctaaattacaggaaacaaacatattgatatttccttgaaatcaggaaatactatactgaaaaacttacataatcacttaaattcagcaaaatcatggcaagaaaaaagaatgagatgaaagcgaaagagcccgtaaagctccggttcaagaaactgtcgaatgcgaaccagtccatatatctggacatctattacaaaggaaagaggtattatgagttcctcaagctctacctcaccccggaacgtttccctgaagaccgtgataagaaccggatcactttgcgcttggccaatagtatcaaggcacaacggatcattgatcttcagaacgagatttatggtgtccgtatgataaacgggctcgggaaaaaaacacttttagaattcctctcggaattgtacaccgataaatccgcgcatggcgacaaagcctattccctacgattaagaagtctggccaatcatcttagagactatatgccgcaatgcttgcttaaagacatagataccggtttcgtgaaaggtttcatcgctcacttgcgtaaacaacccaacctcaaaagcgacttcacgattcacggttattaccggctcctgaatgtcacactcaataaggcggtcaaaaaagggctgatcctctcgaatccttgtggttcgctggatacagacgaaaaaccccacaaacctaccagcctgcgtacttatttgaccctagaggaactaaagaggttaatccggacagattgcgcatgcccagaggtaaaaaaggcttttctgttctgctgtttctgcggactccggatcagcgacttgaccgctcttagatgggaagatatgcaaaaagaaggaaatgataaattccgtttacagatcatacagagaaagacgaaagaggctatttatctcccattgtccgaggaagcgataaaataccttcccgcaagggagaatgacaatgacagggtcggcttgatattccatctacctagcctcacgattatatgtcaggtattaaaaggctggactttagccgccggcatcaagaacaagaaagtgacctttcacgtaagccgccatactttcgccactctttcactagctcttggcattgacttgtatacagtatgtaaattactaggacacaagaacatcatctccacacaagtatacgcgaaaatcatcgatgctagtaaaagacaggcaatagaccggtttaatggcgtattagacgcatgagacggatattacttcagattcgtatggcacggatcaagaaagatacttctccccaagatccgtgtcatccgctatagtttcagtccgcaactggcttatcagatcagagactttgtattatttccaacgaaagccccgtgcattcggcgattaatgaaagatcgacaccggctttcttcatgttacgagcgttgcgtagggtagccaaacgctcaccttctgctttaccttttgtttccgcctcctccacggcgtactccatcgtggccttccagtcacggtagatcttcagattctcatcgtacgtcgcacgctccttgggggacaaggcattcacattcgctacgtcgagcaagcgtcggaagtatgcctctttttctttaaatggggacatatcaaatagattcatattcttcaatacataaattgttttttccaacggagtctcgccctgacgggagatcatacggcaaatgtaataaaaacctcgattaaagaagtaacgttgagggtaattaatactactgagttgttacttcccttcacacaacaaaagcctaatcaactaaagaacacccccctataaccattccccaatagaacttagaaatttattattcgggacaatgatcgcttgcgcgttcgcggcgtgttcaaacgaggatgatcctatcgtaggaccggatcaaccgcaaacaggggaaaataacgcaacattgactatttccgtgaaaaatgtggctagaagtttgactaaagctgcagcggaggggacacagactgaaaatgaagctaaaattacaaacttaacagttgctctttatgacgctaaaactggagcgcttgtcgcttcaacctctgatattgccaatgaggatgctgctgcggataatgatgaggttcaatttgccggactgacagaaggtgcgaaattacgtgctatcgcatttgctaatatgcctgaaatctcattggctggtactacaattggcaactttgtatctcctgtatatacgatgccaactaccggattcgcagaagactatttaccaatgagtagtggtttgtctgatccgttcactttacaagcaggtaaaaattattatggatataataaaattgtgggagaaggtgaatatattcttgtagcagatcccttgtacttgataagaaatgtagcgcgcattgattttacgggacttagcttagacatgactagagctgcaaaagatgtatacgttgaaggaattgcgacgattgtaccagaatgtgtattcatcatgcatgggcggacgaagtccaatgctgcagatatgggtaatggcaatagctggtggaatgtcgttagcaataccgtatggggtaatgtgtccgcaacttatgctgctaatgctacagattatgcttcaggttatagaggagatttcgtgaatgatgacgctatgtttacgaatatgagaggttctattattgaaggatacaaggccagtttaccagccaccgcattggtacaggatatcgcaagtgaaggtgctgcatctgcgtctatcacaaccgcccctaagttttatgtgtttgagaatcctcaagttaaggctgctcgtgaaatgaatggtgctgataatttcaaatccgaggagctggcaactgaaattgtagtcaaaggtacttataagctcgaaaatgctaaaaagagcggaagtaatgcagtatacaactatgcggagaaaacagcatattggcctattaaaattgctgcgacgaatgaaatggcagcagctacggctgagtatttaaaggatggaaagatccatcgtaatataatttacagtattgacgcaactttagccggtagaggatatgatgatcctactgttcctccaacagactttgttgaattgtttgttaagacaaaggttcttgattggggcagcgcaaatcaatcttcagttgtcgaataatatctattctttgaataacaactaaaaggcattccttttatcgggagtgccttttttgcatatataattctggttatgaattgatccggagactacaaaatttactatcctttccttatgatggcgatcccatatgtcttgaacctaagagccggaatattatttcatgagaacatctacaatatctacaattcaacctcatacttattgtaaataaatatgttatatagtggttgcagatgaaataacatctacaattttcattctgcatctaccatgttttaatgggaaacgcaaaaaaatcacttctcaagcttgcggactcgtatatttagtatttgaagatttcataagagacagacaaagggattaaagccaataagagtttcaataggtgaagttagtggtttcatactgaagaaacttttatttcatactgaagaaacaaaagtttctctatagcaaaacttttgtttttctatgcaaaaactattatttattgaaatacagaatgttatacattatttatcgttagtagtaattgttcgtgctaatctttccggtaacctaatgatggtagatcgaagtttgtagtggtagatgttcactatctaccaccataagataaatcatttacaatcaaaagattacataaataatggtagatatggtagatgatttggattatttaccatagaatggcatctggggcgtgtccggagagaacaacttcttaaacataaatcttttaactttctaactttgccaacgggcattgacatattatatttataacaaaaaaggcattccctgttgatagagaatgccttttgattattattcaaagaataagtattattcgataacaggagcttgagtagctgtaccccaattcatgaccattgtcctaacaaacaagtcggctgtaggatcatccttcggctgcgtaggatctgcataaccattaccggcgatagtagcagaaatctgataaaccacgtttctatgtacctgaccgtaatacatgttttcgctatccaatccatcgagaccaatctttatcggccaatagcgcaagacaggagcatcctctttaccaaatgtccaagatgtgttatcattcattatagcttttatataaacttcaccactgacaaccaattcggatgccaaagttgttttatccaggacgaaagcttgatcttcctcttccggatcttcttgttctctggccgctcctgtctgattattaggcaacacataaaaatataaagagttcgcaagagtaattgctttatctccggaaatagtagcatcttcccaattctgagtatatgttgtttctgctgtactcaatgcctttatataattagcagcatcgacagttccagcaaaacggccgaatgagttactagagttagtcccggaataataatcatctccatcagcagtttcataagtagcggcaatattaccccaaaccttatctggcagattgaaccactctgtattactttggctttggtctgccaccttagcttttgtacgaccatgtaatacaaaaacatccttaggcacaaacttaatcgttcctgatttgtatttttgactaccatcaaccttgactttagtcatatccaaatcaagggcattcaattccacacgagccacatttctaattaatcctaaaggttttccagattcaatactgtgtcctcctgtagtgtttgagtaaccataataattttcaccttcggcaagagtgaatttagggctaataccactactcataggtaacccattcgctccttctccggaaaagacatagtaagcagatgtcaactcaaaagagttagcggttgcggtaagagcatcctttggaacattcgcgaaagccaaagcacgataagaagcaccagcctttaatcccttaaactgaatctcattgtttgaatcagtaacctcttcatcctcattagctgtaagatcactaacttgtaagaatgttccgtcctcattataaagggctacaaataaattgtaaatcttagcttcgccttccttggcgttctcatcctcgccggcttttgtctgtgtgctctttgttaagtttttcaccacaatcgtaagatcagcggtgcctgcttccggtgtaggtgtcggatccacgctagggataggatcatcctcgtttgaacacgccgcaaatgcgcaagcgatcattgtcccgaataataaatttctaagtttcatatacatataattttatgagttaataaatcttttatataaacctttctttctcaatcactttttacattttcagtcacataacaagaacgctttgttcaaatcttccccatgaccaatctgttgttcgttgatgacatcgcaaaggtatttggactataaaaaaaagtaaataggtgttactttcataaataagaggtaaaactataaattttcattcgggatattttcgggctgattagcaccgttgtaaggctatcaaaaagaggttgaaaaatatcgtatcaaaaaacaactaaaaaattttgccattccccggcgattttcgggaaatggcaaaacgattaattcttacccggcagatactgtgaaggagtgacgccgtattgttccgtaaaacgcttacggaaagtggcggtatcgttgaagccgaccatttccgaaacctcttggatagagtatcgctgcatactgatcagttcggcggctttcttcaaacgtaccatacgggtaagctccaatatactactatccgagtagagttttatctttctatataatgtagggagactcatgtttaaagaatccgccaaaatcttcgcctcaaaactagggtcatccaaatgtttctcgatcgtcgagataaccgcatccataaaaagattggaaggggaatcatctttctttaccgttttctctacctcgggatgcgcacctacaggactcgacgtatagaaacgtctcatctcatccctacgtttcaacaaactgtttaccttacttcgtagcacctctacatcgaatggcttggttatataatcatcggcgccacattcaatgccagctataacatcctcactctctacctttgcggttagcaagacaactggcacttgcgctaattctgggatgcctttgatttcacgacaggtagcaagcccatctttaacgggcatcatcacgtcacataaaataagatccggccgttcagctcgtgcgatctctacaccctcctggccattatgagcttccgaaacatgatactcactggcaaaaacatgacgcaggaaccaacgaatctgatcactgtcatcaatcaccagcattttcttcccggtctctttctttttcggaacaacttggatcaactcggcgatctcctccttctgcatctcattcagctttaccagatcaccatccggctcgatgaattccacggcacgttccatataatggcttctccccaaaggaatcaatatcgtatattgggttcccgtctcgtcctccgatgaaattccttcgaaaatagcgccggaggattctgtcatatccacgatctgtttcaaacccaaacgggtactttcgctttctcctaacccatcatcttggatagagaaagaacaataagccttgccattcgagcgcaccacggaaatattgatcgagatctttccaaagcggtaggtattttttaacgcattagataaaagtacacgcaaggcaaactccatcttccgacgatctatccagacccaaagaacagaggtttgggtattaatatgaaattccacattattcatggctatccagtccacgaataaatcacaaatctgctttgttatactgatcatgtcataacgagctatccgaagatggtttgccacgtcatctccatgacgggtatttcgcaattgctcgataaggtcttgaagagctaaggtattacggtaagcagacaataattgagtcgcttcactagagtcaatatcatttttacgttgcaacaactcactcaacgaaccaagcacaagcgatagtggagtacgcatttcatgaatcgtttcaacaaaaaacgaattatggagcttttccatttcctcaaggcgctttttcaaatcctcccgttctacctcattatccctattccaattatcagtctcacggattttattgaccaacatttgttggatctcccgattttttacgcttaacgcatcgacagaccgaagaagctcatcgtttctcgccataagctcaccatctttggcaatatactctttcttcaacctatacatataataactcaaaaaagctattacacatatggacactatcagtaaaatgataaaaggtagaattccttgagagctctccattgtatcattgtccgcagcaatataatgagcttcaacgaacaagccccaaaatgccatcataaatttcgctttaaaaccttttgatctcatatcattgattattaagatgttatttatataaaacgccagtaaaaaacgttcgtttaaatcttgcgtttttatagttctagatggactatcgttaaactgaaacaacacgtcaaactatgtctaaattcctaaaaagaaaagaggtctgataagctcaggcctctttcatcttatatttagcaagaaaaatcgtaaggaatctatctctccatcctctccttctcctttatcaacccattccgatacgcataaagcagtttctccaagtccttaatctggctttgaagatccgcacccttatccgtatctttcaccatctggcgatgggagcttaattctaccacgatcgtagtggatttgatatccaagccttcctcgatcgctttcgcccgggattcgaagggttcgtgttgcacaagctggaaaccacgggagtgatatactaatgtatagcccgcaataccggtttccaaatgatacggacgggagaaaccgccatcgattaccagcatcttgccattcgccttgatgggattctcaccttgattggaacggacagggacatgtccgttgatgatatgccgatgcataccggtcaccccaaactcatccaatatcctatcacaaatttcctcctgctctcgtaacgtataataagcgcctttttcctccttatgagtctcggtctcttcgataaaggcacgctcgaaagtagccatcttgcttttatcgaataacggggagtccttgccgccccaaagataccagatataatcatgcgcatattccacttcttcctgttccccggtcttgaaataagccgtacggatcagttggtctacacggtccaacaaagcacggcccttataatcctgccccaagatacgtactgacttaaatgtaccatccggattcatcgggatagaggcatgaaacagtaaattggaattacaaacctgatacattcccccatgccggaagaaacaacgcatatgctttttcatcttctcgctgctctcaaaagaatgcaagatctttcggatcaaatcctcctcctcaatagaaagacgatacggatctttcgggtctaaagtaggccagttagtatctttaagcgtataatcctttccatcgatatgaaccactccccgcttcagatcgatatggtgcaacaacatccggtcatccatctcaaactccggacgacggcggatgatctcaccctccagcttgaactggatgatggtgatcgccttgtgcatctgggcgatcaaacgggtggtcttctcatccattgcattatcggcgaactttgttttcggcatgaataacgcacaaggatcatccccgtacgcctccatcgcgaaagtggccaacggcaaaagattgatgccatatccatcttctaaggtagccatattaccaaagcgtaaacacatacgaatcacgttggcgatacttaccaaattaccggaagcggctcccatccataagatatcatgattaccccattgaacatcgaaattatggtaatcgcaaaggatatccatgatcagatgagcgcccggaccccgatcgtaaatatcgccgatgatatgtaacaggtcgattgtcaaccgttggatcaagttacacatagcgataatgaaatcgtccgcacgtcccgtggagatgatcgtacaaataatctgatccacataagcggatttattcggctctacggaagactcgtgcaataactcctgaataatataggagaactccttgggtaaagccttacgtactttcgaacgggtgtatttggaggacacgttccggcaaacacgtaccaattgattcaaggtcacttggtaccaatcttccagatcttgctcttgactcttgatcagttccagcttatcctctggataataaatcaaggaacaaagctccttcttctcggattcccggagcgtattactgaaaatctcgttcaccttgcgctttacggcaccggaagcgtttctcagcacatggctaaaggcttgatcctcgccatgtaaatcactcaagaagtgctccgtacccttcggtaggttcaagatcgcttccagattaatgatctccgtactggcatccgcgatcgtcgggaaactccgtgccaacaattgcaaataccgtaaatcattttgtacagattcggctataatatcttttgtcatcttatctcttatttatacgcgaatataaatagatccggtcatttaaaccgaacctgctccggtttatttttctcggctacttgctggatctcataggggctgacctctacggcgcctttcgtcaattccggaatattgtaggaatacaactgatagtcatacttatccggatcttcttgaggcaataagaacggtttcgaaggcttaccgtctttccctatataacaaatataaggtaaagtatataaaccgttatcccggcggctactaaatacgacccaatcactattactactccaagaatgatagctatccgtatccgggctattcaacgcagacatatccatcgctgtccgattctccaaatccatcatccggatctccgcatccgggtgccaaatagggaactgcccataagcggtttccgtgtacatcaggaaacgcccatcgggagagatacggggaaatgtatagctcaagctatccgcatgtaccaacgtatcgatcgggaagctgatctcgccacgatccggatcgaacgcgacacggcagagattataacgtaccttatcataattctccggcatcttctgggccggggccgtacagaaataaagccatttaccatccggagagaacgcggggaaagtctcgaatgcatcttttgtgatcaatgaggctttcgaaaggatttctttgtttttcacgtcatacaccaccacatcggactccaagtcgaacacttccatctttttctctttcacggaatggaaaaactgtttgatatcatttaccgatgtggtgatatagcgcccggaaggatgccagaaaggatacgtcatattactgatcgtcccattcgttttcgtattcaatttactgattttcttgtcttggacaatataagttcccccattcgccgcacgcatatggaacatcatctgccccggatctcccatacagaacgaatggcagttcatacaattatagccggtcatatcgttacggataatcggctgttcgtcaaacgactccaaattccgctgataaatacccacaatatgccatttctcgtatcccggctctatcaaacggtatactaaatgagagtcgatcgcttgatcactgatatagacagagaatggtgcccatttagtccactcatcacctatcttcgtggcgatcgtaacaaaaaaggcttttccacggttcgcacgtgtcaagcgaatccaatccttcatcttaaaacggatcgtatttgtcccatgatattcaaatacttccgactcactaccttctattttcgcatagcattcatccgctggtacatttatccggaaattcaacggagctatattataaggtatagtcgtccctttataatccggaaaaataggaggcggggacatacgttcgttcgtgacattcgtaatgccttccggatgcaaggaccaaaagcctaaatatacgactatagtgagaacttgtattattagatatccgatcacaaaatttcggacgatctttcttttctttgtattatccatgtattattgtcgtttaggagtcgggataaattgagcgtaataataataggtatcaccaaactgttgcttcaaggctgccggcggcatagagcgtgccactttcatgaattgcaggaagcgattctgcacctcctgactgatcgggaagctccggaacgcctccggatctttctgtacggccgcgaagaacaagcaaatagcttcttgataaagcaccgggaatgcctcaccccgttctttcatcaattccatataatgcataaaagtcatcaaatccttataaaccaaaagatatcccatcccatattcgaaagccggacggttatcggcatgatcgtcgatcaaaaaagccaatgcgttcggaaagatcaaggtcaggtccaaaggattatcggtaatcggaagcatcgcccgttttgccgctatccaatcttccgacgcacaagccacggagtccaataatggacgttgagcggttgcccaatcccggtaatgcgggttcgattccagtatcttgatatatttctccgccgcacgatattcgccggttaccagataagtctccaccaaacgcttcatcaaacgaggttgcacgcaacgttgtgaacttaatacccccacaaaggcgaaacgttgggcggcgttcacttgcccgacttgccaagccacctcactcgcctcgatcaatcccatccggcttttcggatcgtgcggaataaaaccaccctcaccgatctgggggaaacgcatcaaatcggaagtaaaacgtccggttttagacaaagccaagttcagataaattaaggcatccatatcccggaccgaatgcgcacgagcatgtgagacaatcttctgccattctcccagccgtgcatagtaatcataccgataggcctgctccatcgggtctttcttatagagaatcccggcgaccatcgctatcaaaagaaaaacgtaagaaacgattcgtttccaagattccttacggataaaaacccggttccttacataataaagaattaaaacgatcaaaggatataaaagcccgatatatcctaaagaattaggtatcggatattcgggatggcatagatgtttgctgaagaacgcttcccgcatcggaagaatataaaccgtacgcatggcgatcaacggtagcaaacctccccaagcgatagcgataatggctactccaaaacgagccttatcctctttagcacaacactcataaaccgcgatcaataaggccaacaataaattagcgggtgccgcaaaaaaataagagccccccaaaaacaagaagccaaagagataacgaagccaatcaatcttgattgaagtatacaaatacgcaagaacctgcacgaaagcgagcatcgtcaacaaggcgattgactcctgcggatagatccaaattaaaaaagagggaagaatagccgccaacatagaggcacgcaccccacaagcttttaagtaaaggaaaaaacagccggagatcagtcctaataataaagcgatcactaccgaagccccataaggatggataaacgcaagcgataagaactcagtcacatattcattcaatccacccggttcggccaatcggtcttggaaataactaccggtagtctgaaacatcatatactgctccagaaaacgataccaataccgaaaattcaactctatgaataggaaactacctataataaaaaggaatagtataatggtattattgttaacaaatagtctattcttcattctccaactgtttttcggatcgtaaagatagaaagtatatagaagacggcaaaagaaaaagtttaattattatattgaacacggaatacacgaaacacacggactgatactatatacctcagtgtatcgctgtgtgttccgtgtgttccgtgttcaatcctgtacttacatctgctgctcgccgccgccagagccgccgctcttcacatcatcgttattgataccgcgttttactttcttgatagcatctttcaaggtaccgaaacgataggatacgctaacttgtaacatgcgcatcgttcggtaattggtctcacggcggaagaacgtatcgtctgaagaagtgttttccatcttcattcgtttccagaacgggttctggaaagacaactgaaccgagagctttttcttcaagaaatccttatttacggagattcccgtaaaatagaatggagaacgtttaccctgcaactgaatccaaggagagaaatatcctccatgcaagttcaagcgaaaatccatcgggaaattaaactgcgtaccggcgaatatacgtccgctgaaaccactgttcgccatatcattcatatcgctcttcaaatccgtataatccacacctccattcatataaatacggaacaaaggaaccgggttccaatttgcgtatacgaacaagcccgtagattgtttctttcctatattaccataagtagtctggaaaatacccgggttcttcggatcgataaaggtatattgctcgatcgaattattcacgaacgtataagtagcgctcgcgttaatgctgaatttctgggcgaacatactatagttcaagttaatattattacttttctcagagtccagattcgggttaccgaaggatatattctgcggatccgcattgtttacataaggattcaaataccagatacccggacgctggatacgcatattatatcccaagcgaagctgttgcgccatgctcagttgataagagatcgtagcgtttggcaccacgtcgaaataatgggtgtcaaaattcatatcgggagccatctcgtatttcacatccaaagaagttccttccgcacggacacccgctttcacgccaaacttatcaaacttcatcgaatagcccagataagcggaatagatatgttgggtatgacggaaatggctatccttggaagtaacatcttcccatatattcagcgaatcgttgaaagcggtacgatctgtattactccggctctggcggaatatgtatttcgcgccaacctccaaggtctggtccttccatgtaggagtcgtataatccacctgtccggtgtgctcattcgtagaagccttattgatattattttgcggatagccgagccaaggattgtaattcacgacattctctaattccgtataatccttactatcattcggagaatggctgaaacggtaagagaccgtcagcaactcatctttcttatgggtagagtgctggtaatccacgttcacgtccgtagaaccaaatgtctctgtcgtttccgagttacggttataactgtagaccggattatgattgatatcctgcatattcacgttatactccgagaaacttttcatctcgccacggaataagttcgcgccaacggtcaatagattcaaagagtcgatctcataacttccctccaaataaccgaattggaacggtccacggctctttctacgtccattttgtgtcaagaagtgttccccgtcattttgcaaatcttcccgtacggagttagcgtcattccatgggtcccgctcccgattatagttatagttggcggtaagtcctaattttccggcttttagagatacataaccaccaccgcctacacgccccaacgaactaccgttcacacgaaccgtaccagtatatccttgtagagcatttttcgttgtaatgatattaataataccaccgataccctcggcgtcatacttagcgcccgggtctgtgatcacctctatgtttttcacggaattggccggcatactctttaatacctcagcaggattattactcaacaggttagaaggtttaccattcatgtagatcttgaagttcgtggaacctttcaattggatttggtcatctccatccacggttaccatcggcactttgcgcaacatatccaacgtattgttggtctgtgcctcggggtcatcttccaagctataggtaagtttatcgatctcagccttcaccaaaggtttctgcgccgtaaccgtcacttcccccagccgctggttatcctcctgcatatataacttacccaaatccaagttcctctgtttatccgagatcgtaaatgttttctcggcaggagcttttcctatcgattgcatagagatgatgtatttgccggcactgcttaaaggtgtctgaaacttaccatccacatcacacgctaaaagcttgaccggcttatcgggggttttcgctaaagcaattctcaacgtcgcatagggtacggactcgttactcagcgaatctaacacctgtcccttaattgaataggaaccggttttatcagcctgcgcatacagaggaagcgcaaggaacagtacccaaaataaggcaaacaatttttctttcatacgttcatcatctattacataatactatacttatctctcaactttttgtactaaatcacactgtttacgattgattcgtacaaataaagacattaatatacgttcgtaagcattttttcctcacaaaaagtctgaaaaaactttattttcatacaaagacgagctttgataccgataagttgcatatttcctcatctatatcctttatgaaccgctctccaaagcctttacatcatcgttctttataccacgtttcaccttcttgatagcgtctttcaaattaccgaaacgataggagatgcctataccaaatgtacgcgtcggagaatagctgatatcttgcctatggaaagtatcgtcgtagatcgtagcctccattttcctgcgtttccaaaacatatcgtaaaaatagagggatacggacagtttcttcttcaaaaaattcctgctcacatagactgtagcgaaattcaacggcgaacgcctcccttgcagctgtatcgccgaagagataaagcctccattcagattcaaccggatatcgagtggtaagttaaactgagccccggcgaagacacgcccgctaaagccactgttcgccatgtcattcttttcgctcctcaaatccgtatagctcaagcttccattcaagttaacgcggaacagggggatcggattccaactaccgtaaacaaaaaggccggtagtctgcctcttcccgatattcccgtaagtagtccggaaaattcctggatccgccggatcgataaacgtataccgctcgattgagttatctataaatgtataagagatacttgtattgaaactgaacttttgggcgaatatactataattcaggttcacaccgttactcttctccgaatccaagttcgggttaccataagagatgttctgcggatccgcattgctcacatacggattcaggtaccagatacccggtcgttggatacgcatattatatcccagacgaagctgctggctcatactaagctggtacgatacgacagcgcttggcaccacgtcgaagtaatcgttcccgaaattcatatccggtgccagctcatacctcactttcaaggaagtcccttctgcccgcgcaccagctttcaccccgaatttcccaaatttcatcgtatatcccagataggcggaatagatctgttgcgaatgatcgaaatggctatctgcgggagtcgcctcctcccacatttgcgatgtctggttgaaggccttacgatccgtattactccggctctgacggtagatatactttatgcccgcctccaagctctgatctttccaagtaggtgtagtatagtcaaactgcccggtatgctcgttcgtcgatgccttattgatattattttgcggatagcccaaccacggctcgtagttacgaatatccgtcaactccgtataatcctcgttatcgttcggggaacgactgaaacggtacgagagagtgagtagttcgtctttcttgcgcgtggaacgctgataatccacattcatgtcagctgagccggacttgcggctcgattccgaattacgattataactataaacggggttccggtcggcatccagcatcttcaccgcatattccaagacgctcctcgtggttccgaggtacagaccaatccctacagtcaataagttcaacgaatcgatctcataactaccttccagattcccgaaatgataaggggctctcgatttactacgtcccacctgattcagataatgttcttccttattattcagatcctcacgcatggaagaagcatcgttccaaggcgtattgtcacggtcacagttgtaattggcagacaatccgaacttgccggctttcagcgacaggtagccgctcccgaagatacgcccattggtgatggtgttcaaacttaccgatcccgtataaccctgcaaggtgtttttcaccatgatgatattgataatccccccaattccctcggcatcatacttcacacccggctccgtgataacctcgatgttcttcaccgagcttgccggcatgcttttcaacactaccgacggattattgcttaacaaattcgatggcttaccgttcatgtaaaccttaaaatttgaagaccccttcaactcaatcttatcctcaccgtccacggtaaccatcgggaccttacgaagcatttcaagcgtattattggtctgtgcctcaggatcatcctccagacagtaaatgatcctgtcgatctctgctttcaccaaaggtttctgcgccgtgaccgtaacctcttccaaacgcaggttattatcctgcataaacagcacgccgagatccatgactttccgttcatccgaaagggtgaataccttctctgccggagccttcccgatagattgcataacgataatatacgttccgatgttattcagcggagtctggaacttcccatctatatcacacgccaacagcttgattggcttctccggtgtacttgccaaagcgattctcaatgtggcatacggtacggattcatttgtcagtgaatccagcacctggcctttaaccgtaaaagaaccggctttatccatttgcgcatacagcggaagcgcaaggaacagtaccataaataaggttaacaacttttctcccatacatgcgtcacttattacaaaacacaatatattccactcataacactgcgtttacgatttattcgtacaaataaaaacattataaacattcgttggctattatttctcacaaaaagtctaaaaaaagaaatatatcattatttttgtacatctaattttctaaataacaacattatgagaactattttttgtgtattagccactttgatgttaggtctagccggtatgcaggcccagagtttaaaagccattaagttgaatgcccccgacaagacccgaggcgcttcggtgatgaaagccttggccaatcgtcactctgaacgtgagttcgccaacaagaagctcagccagcaagacctttctgatttgatgtgggccgctatcggtatcaaccgggaggatggaaaacgtaccgccgcttccgccttgaacaagcaagacatagatgtctatgtacttatggaagagggcgcttatttgtatgatccaaaggcccaccaactaaacccggtagcggaaggtgaccatcgtccgttaatcggtggcaagcaaacctccgtgaactctgcccctgtttgcctgttgatggtttctgatatttctaagttcggcaacgtgggcacaccgcaaatgcgcgagcgctttggagcgttagacgcaggattggtctctcaaaacatcgccttgttctgttccggatgtggtttggttacggttccccgaggtagcatggaggctgatgctttgaaaaaagtgttgaagctatccgactcccaaatcccaatgattaatcatcccgtgggttacgcgaaataataggattatacacgtaggctcacgagaataatcttgtgggcttacgaggattcctcaccgtgttgctgggtgaaaaagtgagcatcattgaattactcgagagcaaaggtaatcaactcaccgccgacgataagttcaacaaggtagacatcaaggccagaaaccatatatttacgtccttaagaatacggtcttacaacacaacttaggggcgtaaatatacaagccaagcgatcaaggccagcagaacgaatatgatcaccaagatcgtattcccccaccggatcaaaaaagaaggcatctcgccgatcatgttgcggactttctcgctacgcaactcgatacggtcttgatccgattccgcttttttcttcatctcattgtatgttgacatatccttaactccccaactctaattgattcttcactaaattataataagcacccttgcgatcgatcagcacgtcgtgggtgcctacctccacgatacggcccttgtcaagaacgactatttgatcggcgttgcgtacggtacttaatcgatgggcgacgattatgactgtcttaccccggtaaaagtccgtcaaattctctactatagcacgttcattattcgcatccaacgaattcgtcgcctcatcgaaaaagagataagaagggttcttataaaccgcacgggctattaagatccgttgacgctggccttggcttacgccttgaccatccgaaccgataaccgtattatatttcaaggggagacgatcgataaactcctctatattcgcgatacgggccgccaacaacaaacggaccttgtctatctcaccgtcatcaaccgctatattgcgggcgatggactcggagaacagataaccgtcctgcatcacagcaccgcactggtcgcgccaccacgacaagctaaaggaacgcaggtcattgcctcccacacggatatcccccacgaccgggttataatagcccagcaataatttgatcaacgtagtcttaccactgccactcgtacccacgatcgccgtgatcttcccgcttgggatacggaggctcacttggtccagcaccttcggggaatggatgccctcatactggaacgtcacgttacggatctccacatcccggttattcccgttaaagcccgttatcatgcgctcttccgtctcctcctcctcccggtcgcggatctcgctcatccgttccagactaatcttcacgtcttgccaactataaagaaactgcacgaactgttccaccggagcgttcaactgcccgataatatactgtatagccaacatcatacccaacgacaggctccccccgatcacagccgtagcggcaatcaccgtaatcacgatattctttacctcattaatcaagatactgccggcctcctgactctgttgcagccgcatcgattcgatgttcgtccggaacaagtccgcttgtatatcctcccattcccaacggcggcggcgctcacaatgctggagcttgatctcctgcatgccgttcagcatctgcatcgtcttcgactggtttcgggcccgctgctcaaaataggtataatccagcaaccggcgtttcttcaagaaaagcgtcacccatatcgcatataaggcgctacctagcacgaatatgccaaatatcaatcggttataataaagcaatacccccccaaacacgatgaaactgaaagcggagaagagcaccgtcaatgtctgcgccgtgagaaaacgttccacccgttcatggtcgtggatacgctgcaacaagtctcccgtcattttcgtatcgaaaaacgacatgggcaaacgcatcaacttaatcaagaaatcggagagcaaggagatattcacccgagcgctaatatgcaataagatccaacggcggataaagtccacggaggcacggctcagcaccagcatcaattgtcccaccaagatcagatagatcaaattcaaattctttccggctatccctttatccacaatcgcttgcgtaagaaacgggaagatcaattgcaagacgctgcctagcgccagtccgagcaacaattggataaagaaacgtttatagggtttcatgtatccccacaagaaacggaaaggatctttccccgtatgccgttcatctttccgttcgtaaaatgcgggagtcggctgcaaggccatcaatatccctttttcctcccctctcgaacgggtactgatccacgcattacgaaactcatcctcattgatccgtaatagattcttgccgggatcggcaatatagaaaacatattcaccatcccgtttctttttagcgtcatagagtacgacgaagtgatcctggttccaatggaggatacaggggaaagggcgttgatccaccatcttccccagggtcattcgtccacatatcgtacggaatcctatatactcggcggcatcaaccatacccaacaaggaaactccttctcgagagacaacgcaaagcttttgcatcgtctcggcggaatactccttgccgtggaacttggcgatcatacgaaggcaagtggcaccgcattccatggagtctggttgtttgatatgagggaatttgttcatttttttattcacatcttattacttcatttcacaattcacaagaaaaaataatgcacacagaaagcttcttttatttttttgtaaaaaatatcagtgttcaaacctaatgaatactgtttgaattcttcttgtgagacaggcattaccttcttcgatggaaaaacagatacagtaaaatgatttttcatataatctaggtatcttgtaatctttaaagcacctaggttgttttcaccgtagaagaaagtcttattatgaatagactcttcgatttgagacagcagaaatatccaaaaaacatttttagcggtagagcctataaatgagttacccagcaaaggatgtatctttagcaaatcacaatgtccttttggttggttagtgaaaaataattgagagtcgttgaataatggcgatattgattggaaacattcggtgtctaaattaacatagagtcctccatgaagatacaatatcatgtatttagctaggtttaaacgttgccgttgggtaaatacagatttatacagcagatagaaatcagagaaatcagagaatagtaagctctcaacctcagctgaacaccaaagatgatagtcccaatcaggattatactttttccatgtattggaaagtatccttagattacagggcatcatgtcctcactgtctgcaatccatatctgatgtatgatcttattcattaaaaactaattattttatgatactacgtacaatgttaaaacagatgatcttgtttcctgacaggatttgatccaatagtagattagattcaataggtaaacaatctaccatagtagttaggtcactaacaaataactcatcaaaccacgggatgtttttatcgtttaatacagtctttccataattgtagtaatgaattagaccttgcaatcctgtatcaaatgagagatcctctagtctacgcaagtcttgccgtaggatatatctattaatacgtaaaattgtttcggttatatctttgtgtagaaaaccattttccaacaaatacaccaatccccaagctacaccagccaaacctgtagctaaatcaacagattctttatacgagagattctctaataaatccataagcaacccttccgctaattcattatactccgattctccactatagttactataatggaagaacaatataatcattcccattttcccattgtataatccgacatttgagattaagtccaccctaaacaatgcttgatgtgttgctttaataaccgtgtctcgatccaaatcaaataaaagattccgtaccatccgtattgtcatttttcttataaacactcagcttcttatcccaagccccgaaaaaataatgcgcacaaaaggcattctttatctttccatagaataaatcagaaccaacacctttcctatagttttgaaaatcctccttacagacgggagaaaccaaataagaagaaagcgtagatgcaccatattcatcccttaactgattaataagcctagataacatatatggaccagtagtattcaatacgatatcatctctatagatcctgtttttaacagtaaaatctatatcagacaagatgcgtaaccagcccttatgattattagatgaacccataaaggcgtttcctaccactctctgctttgatccattaaaacagacccaatgctcaggaggttccattcccaaaaagaatgacttgttttctacaagagggtctatagatttaaaacattcaatatctaaatccacataaactccaccatggcaatataaaatcatgtatcgaatcatatccaatctctgtatattaaaaggtaaagaatgataaagattagcccactctgggaaataagaatccaccaattctaccatctcctttttattccaaaggtgatattcccaatttgggttaaatcttttccatgtacatgaaaggatcctcaactggaaaggtacattatcaccatcccatatttgatgtattactttttcaatagccataatcaaaacctatcctcattagctaaagattcatactttttgtttatctcaagaaatgagtcgaaacccgattttaaaatcgtagagtactcctttatgagattttccaacatttttcgatgctctagcatgatctccgtagcattcctaagatagatgccacaggtctctcttagcatattgtatatatcattctttagatctgaaggaaataaagtctctagtataagtaacttattatagacaaaatagtttagatccatttcgtatgggaaaccagttctgaatatatggccaatctccgtatccttgataagataacatcctcctccttccatccaagctttgatactgatgtagggttcctcaaatccatattgtttcaatccttcatagcctcttatatactgccaatatcgttttgaggaacaataggttgcaccatatacactgggtatttcaacaatctcacgttcgggatgcaaatcttttctcatccacgtaggatttaagatgttattcttgtcttggaaattgatatatgcgccaaaatgcggttttccttcgacaaagtttccattcaagtctaacgtcttgcaattagcgcaatacaccgctcgttgattgtcacttgtcacctctacgattcttttccaccagtcattatcatagaatcgcatatgtccatctacagtcaaaaaataatcggtctctatcattccgatacctaaatctcgagaaaaagcaggtcctaaacgttttttattcaccatgtacttaaccttatatacccttccgatctcctcataatcaaaagagtcggtcgaggcatcattgatcagcaggatgtccacattatctcttgctgtttccctaatgcttttaacggtctcgcatatttcagcaccttcattcaaaaagggtatgattactgttaaattcctcatggtttttgatcttaataaaaatattcatctatctgtatatcctaatcattttacgattcctgcatcttcatccacataattatagatttgtttctgcgatcccttgtacttacgccctaggtcaaagttccaagcaatactgagccttacctggtttccctcgtttcttacgtaagaagccgtactcttttgaacgtacgctgagttcagtaactctttttggggtgtcccatctggcaagaacagattttgcacgctcaactcatattgtatggatttatgtcgatagcggagcgagatgtttgctcgagcaggaaaaatcagaactgtctcacctgactgcatctttgacttgatcgtataagaggcagataaagaccagtccttataatttccttccaattggaagccaccaaatgtattggtcaaagattgctcaaaattgtttcctttgtctatatatcggttcagtacgccaaaagcagacagattcaatcgatctctcacaacctcccaatttgcatacaaatacccttggatatgctgatggaacttttgattctccggatgatactctaaataatgatggccttggtcttcccgcaggtaaatagaattatttatgaggttacgagtgtactggtagaacaaccgaggggcgaaggagaaagcacccttacgaaaattgaacgtaaaattgttggcataggtctcagcaggaaccacatttggatttccgacaaacaattcataagggttttgccattgcttgaaatcactcatataattcagagtaggcaaaaattgcaacataaaaaagttatacctaaatgagatattctccttgaaagaataggctagtgttagtatcggtcgaaactgccacttcgaaaaatgggtatcctcttccttgaaatatatcctagaaaagcctgcccctacttgatagctgaacttgcttaatgcaccttgcaactgggcatacccatacacgtccgaattattcatcgtattggtaacatccgctccctccatggtataaatattctctgtgtgagattgcgtaaagcgtaatccgacggagaaatcaatagcttgactgaaccggttctcatagatggcttctgcttgcagagtttgtttctttccatctgtattgtatgaatagttatacagggattcattctgattattttcttgatagtttcgaaaataatcagaggaaatatacgtcgctaccacattagttaaaaaagtttgattcttaccgagttcttgttgaaaataaagatcaattgatggcgtataatttctgtttttcgtatgaagtaaagaggtgtaattcattttgtttaattcatctattacattttgttttgatacttgatcaggtacgctaaattgattccgaaaaaccacgttaaagacagtcttttcctcattgtgccaattgtaagaaagagataggtcatgtctctccgattttatgggttctttcactccctctttggataatacaagtttttgattcggcaaaaacagcttcaagtactcatccttaaaactgtctttatacttcgaataggagatacggtaattcaagcccaactccgactttcggttgttgtattttagaaaaacttggtcgttcgtataaggtgaagtaagagctatctgagcatttcctccaagggataatccatactctattcgtttcagaacgaaatttatcacggtgccgacattgccatagcgcatgcctggcaaatcgatatattccacttttttaatcttttgtggatcgagggcagtaatctcatctattgtcacctcaatatcattaatgcgtaattgtacgggccgatcgttaatggacgaaattgaacgatcgcccacatttacgattaatcccggcagcatgagttggtgaatcatctccaaggcagagaacgacctttctacgattcctataggggggaatatcacctgtcggtccattttcgtataattgtctgccgaaaccacaatctcatccaattgttgagtgaccggaataagctcgatagttccaaagtctagattctcctgcgcattccttacgtctatcaaggttgaacgaaatcctatattggaaaaacgcaatacataatcgcctactttgggaatattaatacgaaactttccatccgcttgcgttgcatcctgggagacaacaaccgagtcggaatttagcgtaagaatacttacgccctcgatacattcacctgtttccttattaacgactattcctgttacaagaattgcatgaatatgaaaactcactagcaaggagaagaaaagcaataattgtttcatagcacattatctatttaaggtgtaatctttgttagattttagatttcttgctttgcagaaacatttgctccgcccaaagaagtagatatttgtcgatagacatacccatatgttgcatggagcatactttatgcaaatctttccaatttaactccatacacttttggctgcaaggtcccatacaaacaggaagcatcttacaagccaagcacataggattctcaaatgtagttctaccaagcctttttgacagagtaacttgattccacacgatatctcccgcatgggttaatatgccttctgcattttctttctttaaggttcgcccattacaacggtatacattgccatcataatttatgatggcaaaatcataatcttccgcaggacaggaataatctcgaattttcatattcccagactgaaccgtaaagccttctttttggaatttacgaattgtttctagcaataaggatcgttgctctttatcaccggcagattccattgtttgccagacacgttccatgtggactaaaaatttactacgatccaagccttgtaaatccttgatcaaaggatctatatttcccaaagtcgcatcatcataatttattcgaagggttaccacaaaatcttcttccaaagcaggaatgttatcagagataaggtataatgaatccagtattttatcgtatgtttccgcattattgattttccctatacgcactttgtcatgtttctccttgttcccatccaatgttatttgaaacacaggattcgttgatcgcaatttgtctatattttccttattgataagggttccattggttatgaaaaacgaagtgtagtttacaccagctcttttacagatctcacgagccttatctgctaaaggatatgctatctcatcgaaatagagtaaaggttctcctccaaagaaactcaaaacgaaagagtccacttgtcttaactgaacttttttctctatgtatttcaatatgttttgctttacttcatcgcccatcttcgagtttgccacatggctctcatagcaataccaacattttaagttacagtcttgagtaggataaaccatcaatcgtaatcttcggctaggactaaatgtcgcaattttatgcttcagtcttatttctgccaactcatcccgttcgtcagagatcaagaaaccactacttactaaagtatcataatgcgatttaaatgttctcttgaaatcagactctgccatagacatgaatgagtcatatacatgattacttacacagatgagagtatgtgtaaatgagttataacaaataacaaaacctttttgcttaacaaagatattataattactttttttcataaacgttttcttttatggctacacaaaactcgaacgcagcggttctaatattaaaaatatccgaaccgccgttcctttgattaagccccagagcaacccgttccacatgtgttaccacaattattaccacaattggttccacagacactaccacaattagatccacagctacgtgtagccccacctcttacaagaaaaagctcatcatcagaaaggacaagatcatcaaatagtagtcgttcttctttctctatttgtctcataacattatagttataaagtctaaaattctctctctaacacttttccaaaatggcagagagtttaaccaaaatggaaatgtatacaacagaataaaatcgtcttccaagaatgatatttaaggttctttgaggaaatatggcacacctcgtccattctcaacccaataccattcgtctgtctcttcatcataaatccattcaccacccttaatggcggaaagttcttccttcgacaacaaatcaccagtttccatatctatatgctttttagtctgttacaaaaatataagtaaaatttcgtactatatctaacaaacacctaatttttgtctaacaaaaagctaacaaaacgagaaaaacgtatcttttttaagattattcattatcttcacatccaaaataacgaatatatcatgaaacactccttatatattacgaccattatgttgctagccttaacactctcccaaggatattggttatacaatatatataacgctgaaaaatataaaacgcaagaaatccttgaagagctattcgaagaggctatcaagcaagaaatgtccaagcgaatggttcgcaacaaaccgaaagacctcagcaaccccaaaagaatcataagaagagctagtgatatgacaccagaggaacgagccaagctaaaaggagataccataaccttatcacaaataaaaaatcggaatctaaaagataactatgccgaccttttaacgcaacgtatgcaagacggtctacgtaatgcgaataaacccttaaaaccaaatgtattagacagcctattcaataaaacattaactgatcacaatttacaagcaatatcttatatagaaatatcagactctacccggcaaaccgtaaatacggtaggaaaaaaattcaacctttcattttataagttccaaacagaaaagcttccgataggaacgcaaggattacaatatgtacaggctttcgttaaattacctctttctgacattgtccaacgaatgctcttggcttttaccgtatcttgtctaatcatccttacctcggcgagctgcctatattatttattaagaacaatacgtaaagcccacgcccaactccgagaccgtgaaatagccgttcacagcgccatccacgacttgaaatccccgctgaacacaacatatgcctctatagattttatcgctagccaagagaaagagccgatgaaagctaacatattaaatatcggaaaaacacaaatccgacaattgatagagatcatcgaatccatgctatccctactgaaaacagcggatggaaaagagagcgcacgaaggtcgtctatagaaatcaagtcatttatcgagcaaacgtatcaagcgatagttaggctctatcctaacaagaaccccttgttcaagcttgagaaaagcgaggatttccccgacatgatcgaagctgataccgttcgtctggaacgttgcctacggaatttgctagagaacgcattgaaatattcggatgacgatgtacgaatcaccgtaacgttgactatgaaaaacaaccattaccgaatagccataaaagacaccggttggggaatccccaagaaagcccagaagaaactcggacaacaattcttccgggtgaaacaagccgacaagccagcgcaaccgggatatggattagggttgagtagcgtaatgctaatggctaaagaaatgggcggctccctaacttttcagagcgagaaaaatgtaggttcaacatttttcattaacttgccggccgaaaacacataacacgatatggaagataagctgaaagtgatctttattgaagatgacccaaaccttggattaatcatcgtattggccttgcaaagtaaaggatacgaggtttactacgccaacacgttaagcggtattcaagacatgatagaaaaagactaccctaatatcctgcttctcgatctggaagttggcaatcaaaacgcattggattatttgccttttattcgttcaaagcatccttcattgcctgtactgatagcctcttcccacaacgaaggggaggaaataacacgctgctatgaagccggagctaatcattacaccaaaaaaccgtatgatatacaagaaatagatttcctaatccaaaggttttgtaaaaaggccagtccgatatcaaatagtatatctattggagattaccaactggaactctccactcataaattattctataaacaagaacagtcaaaaacattaagtcctaaagatttcaagttattctatctgttatccgagcaattaaatcagccagtaagcagagaaaagctttttcatgaaatatgggatgggcaagaagttcatgatagcctaaacaacagcatctcgcgtttgcgcaaattattggaaaaagataccacactttcaatagatgccgtaaaaggagttggatatatattatcaaaaaaagaccaactctcctcatcgtaattaagggggcttattgtagatttctagatacgcccttgttccctatcacatgattcgggaaaaacacgtacgacttttttgaaaaacacgtacgacttttcccaaaaacacgtacatgttttgagtaaaagatcatcctgtttttagcatactaacaatcagtatattatataattcttttcattaccaaacttattgtttggaatttatatcgatcctatagggacgtagcgtgcagcgtttgctacctaaagagttttcattatcttcgcggaaaattaattgagatgtggacgttctttatcatacttccaatcctgtatcttgcagggaatatttacatttatctaaagggaaaacaggctttgaaaagccagtctaccggagttaaagtgttgttatccattgttttttggggaggagctttatcgttcttcagtagttttctattccggaatctggatatgccggcttctttcgctcaaacagtttcccaagtaggaacaggatggctcgtgttcactttatacatggtattggccttgttagtatttgatatcttacggcttttccacctacatttcaaatactcattctatttatccttattcttaacactcagcttattaggatatggaaactataattaccaacatcctgatacacgagttatcaacatggttatcaacaaaccggccgataccgatggacagccgctgaaagtcgtagccattagcgacatacacttaggatacgctaccaacaagacgatgcttgccggatatgtagatatgataaacgctcaacgcccggacatcgttcttatcggtggagacttgatagacaacagtgtcgcacctctgcgatacgagcatatggaagaggaactgtccaagatctacgccccattaggcgtttatatggtaccgggtaaccatgagtatatcagtggtatagaggagagcgagaaatttatagcgcagacgcccatcgtacttttaagggattccgtggctatcttgcccaatcagatccaactcgtaggacgggacgaccggcataacaaaggacggaaaactttaggtcagcttaccgcgaaccttgataaaagcaaacctgttatcttactagaccatcaaccctacgatttagagaaaacggaagaggctggcgtagacttacagtttagcggacatacacatcgaggacaagtatggccgatgaactggatcgtggatcatctgttcgaattaagttacgggattaaaaaaatcggaaatagtacgatttatgtctcatccggcttatctttgtggggaccgcctttccgtatcggaacggacagcgagatggtggtgttcaatattacattcaaagagtaaagatgaaagtatttattcaatcgatcgtagcgcagctattactaaatccgtatattttctggagaggatatcaagcgcttcctcctaagaaaagttgccggattccttttatcttgtttttcgtactcgaactatcgctttattttttcggatttatttttaggaatgaactacctgataacgtgataatcacgatccaatacatctgtaacacttggtatatagcgtccatttatatcactttatctctcttggtacttgagttgatcaggctctcccaacgtatcaagccatggttccccaaatggatgaaagggcattggcagcaaaccaaggtaaccctgttttttcttatcgtattcggtgttaccggtttaatgattcacgcataccatacggtaatgaatccgattgttaagaacgtatatatcacgttgcccaaagccgcgggggatcgggatagcctgactattgtcatgatgagcgacttacatatcggagaggttatcgggaaggacttggtacaaaaatatgtggcgctcagcaacgcacagcatccggatatggtggtattagcgggggatatcatggattatgaatcccggtttgcggaaaacgcccacatcgaggatgatttaaaacaattaaaagctccgttgggcgtatatatcgtttacgggaatcatgaataccgggcaaaccggaacgccaaatatcgttggctgcaaaagaccggaggtacgctactaatagactcggtggtccaaccggactcaactttttatttgatagggagggatgatttcatccataagaaacgaaaatcgcttcattcgttaatggaaggggtggataccggcaaaccgattatcgttttggatcatcaaccttggtcgttcgccgagatgaatatgaatggggtggatttgggactgcacggacatacgcataacgggcagttatggccttatcccctgctgatgaaacttgtgtatgaatgcccgtacggatattataagaaaggacctacgcaattctatgtatcttccggcattggtatagcaggacctccttatcgggtgggaaccgtctcggaattggtcgtattgcatatccgcttcaaagcccccaaacagactggcgaaagagggaaaagcacgatgcccattcaagggagctgacaatgggcatcgtaagctcgcttgaatgggcattgtaaggccctttgaatgggcatcggcagaaacccgcctattcggtacccttggtggccgcttccaactcaaccggcacgctcaatgtacgcctgtataaatccggatcgcccaatacctccaacgctttctccaatacaagatcatctttcaagctttcttgcaactctcctcgttggtaataataacgttttacgatctcggcggccattactcgtttcacctcatccttgaaacgatcgaaatctttttccagattcggagtcagcttagcctctaattccttgaacgcagtagaatcctcctccagatacccctcgaactcagccacttctttcaagttcttcaatactttctcgctttggcggtcatacgtgaaattcttggacttggcgtattgcttcaaagcttcgaaatcctcatcggaaaccgtaaattcctcgatgggagcgattgtcttatgcttttgtgcccaatccgtaacgaagtcgaacaagaccgtatccgccgccaaataatacatcatggtaggcactttcggctccttcacctcaaactccggacgtacaccacccccatcacgaaccggacgcttcttggacgtatagaatacggaagtcaagctatccggaatagcagccacgctaccatcctctttccggtgcgaataatcgatttgctggatgcaacggccactcgggatatagtatttactcatcgtgattttcactttcccattataaggcaggtcacgaggagcttgcaccaaccccttaccaaacgaacgttgtcccaccaacacggcacgatccatatcctgcaaagatcccgatacgatctcagcggcggaagccgtacctccattgatcaatatagccaacggcattaccgtatccaaaggctccgtagaggttcggtacgtacgatcccattgcttgatctttcctttcgttgaaagcacctcgctgcctttcggtacgaacatacctacgatttgtacggcaccttccagcacgccgccgccgttaccgcgcaaatccagtaccaaagacttaatattatgatttttctttaaatccaagaatgcctctttcacctcttgagcactcttgatagtaaatgcctttagataaatataaccgatactgtcattcttaaccccgtagtaagtaacttgaggtgtcgtgatctgtttacgggtaatctcgaacttccggggtttcttctcgcccggacgttggatcgtcaaaaccatcttcgtattcggaacacctttcaacaactcgctgacccgggagtttgtcgccttggaaacatcgatcgtatcgattgccaagatcagatcgcccggcttcagacccgctaaatcggccggcattccctcggtaggctcggcaatcatcacgcctccctcgttgttacgctgacggatcaaggaaccgatacctccgtattcgccggtcgtcatcagactcaattcctccgttttttgctcaggatagtattccgtataaggatctaaaccagccaacattgcctcgattccccgctgaacggttttatccacatccactgaatccacgtagaacatctctacttctttcaataaagaattgaaaatgtctaggttcttactcacctcaaagcggttatctttttgcgcccatcccggcactacgctacttgcgacgaacagcaagcaaaataaacctataattcctcttcgttgaaccaatctgtacatacaatatttagttaattaacggcataaatgtaaggaataatacgccgcctaagccaatatcccttttacttttaactttatttgttcccatttatcatacggaatctccgggccaaccacgtcaatcacatagcccgccaacatcgatccgatgcgtgcggattgtaccaaagacgctcctatggattgaccgtacaagaatccggcggcgaagttatcaccggcgcctgtcgtatcaacaggtttgcccccctcagccgggacagaataaaattgaccatgactaccgatcaaggcaccttcctttcccaatgtaaccaatgagacctctaccaactcagacaaggtatgtacggcctcagcagccttctgcccggtaaaagcctcagcctcactctcattagagaacaaaatatccacatatttaggaatgatatcctccagcattcctttaaaagcattcacgatattgaagttcgacaaatccagcgctactttcaagcccaactttttagccttctccatcgtagaacgaaccaacggttcgtttacgagcaagtaaccttctatataaatacattgatatttacttagcatctcctcggtgatctcatccggggttattgtcggggccgggccaaggaaagtccccatcgtacgttccccatccggagaaatcatcaccgtacagctacctgtaagtccatccgtcttgataaaataggaagtgacacccgctttttccaacgcatcctcataaaatccgccgatcgaatcatccccgatcttaccgataaaaccggaattcgcccctaaagaagacatcgaacgcatcgtgttgcagacagatcctcccggggtttgcgtacgtggcaagccggctaaagttgtacggatagcgatcatttgttccctgttaatcatatccatagctcctttctgtatcccgatttccgataggacatcatcattttcaagcctcaataaaacgtcaaccaaagcgtttcctaaacctattgtattcattttttcgtaatttttttcgcaaagatattgcatatttcgaaaataccccgtacttttgcagtgcaatttcagaaaggggttacggaataacctttgaaagagcgaaaaattcttccttagctcagttggttagagcatctgactgttaatcagagggtccttgaccattttgtacgtgcctatcacgatacttacggcatgccgaccatcgtgacaaactgctcaaataactatggcccctatcaattcccggagaaactgatcccgcttttcatcaacaacatctgtcaccgcaagccgttgccggtctatggcaagggcgagaacgtgcgtgactggctgtttgtggaggatcatgcccgtgcgatagacgtgatcttccacgacgggaagatcgcagagacttacaatattggaggattcaacgaatggaagaatatcgatatcatcaagctcgtgatcaacacggtagatcgcctgttgggccgcaaggagggagaggatatggatctcatcaactatgtgaccgaccgtttagggcatgatgcccgctatgccatcgattctaccaaattacaaaaagaactcggttgggaaccatctttacaattcgaggagggtatagagaagactgtgcgctggtatcttgataatcaagagtggatggaaaatgtgactagcggggagtatcagaagtttaataatctttaaaaatcacagtttatccttatctggtttctgactagggataaattgcccgcttacaaatacccgcctacgtttatgtctactgaaaatgtaattaacaatcaacgaatagcaaaaaatacttttttattatatctgcgtaccatctttgtattggcggtatcattgtacacaagtcgtctcgtgttgaaggtgcttggagtggatgactatggtatttatcaagtagtcggaggtatggtgactatgtttggtattttgtccaatgcattgtctgccgctatcagtcggtttataacttttgagttaggaagtggtaatgtagaaagattaaagaggttattctctaccagtgtggttgtacaatatgtattggcgggcattgtctttatcatcgcagaggttgttgcgatatggtttatggagacagagatgcagcttcctaaaggtagagagtttgccgctaagtgtgtattgcattgctcgctgttcactttttgtgtgaatttgataagcattccttataatgcgtgtatcattgcccatgagcacatgaaagctttcgcttatatgagtgttgtagatgttgttttgaaattgattgcgtgtttgggagtgatgtacactccaatagataaattaatctcttactccatatttttagcagtcatctccatttccataagaatactctataggttttattgtaaaaagcattttgaggaaactaggggatctattgcgtttgactggagcatgttcaaggagatgttaggattctcgggttggagtttcttgacaaatgcaaacggtattttaaatacgcaaggtgtgaatatgcttatcaatgtattctttggtgtgacagtgaatgcatcgagaggtatatcttctcaggtagaaagtgcagtattgcagtttgttaacaactttacaatggctgtgaatcctcaaattatcaaaagctatgcgactggcgatatgcaaggattatatacattgatatgccggggggctaaattcgcttattttgccatgttcatcatggtgttacctttggtatgcgagacaccatacgtgctaagtgtatggttgactatagtacctccacataccgtgatatttgtgcagttatctttaatattgggtattttcgattgtataggtttttcttcttatacagcttgtatggcgactggtagaatacgcttatattctatcaccttagcgattattggagtattggaattccctttaacatggatattttttgtttatggtgctccggttgtctctacctattatttatacatatttgtaaaggtcttagtacttatagctagagtgatgctgttgcgtgatatggtcggtctgtcaccccaaatgtatataatagaagtgttaattcctattctgctcactacgctcatagcaataattccttctttactaataataagctttcttccgtcatcatttgctcgtttgtgtatttcggtgattgttgccattatttctgtcggtttatccgctctttatataggcatgacccgaagggaaaggggagtaattctggagaaagtcaatagtgtggttaatcgattaagaaaatgaaagagagtaaacctgtcatatttggatctggcgcttcatcaagcaaggattttaaaagtttgtatatcaattgtcatgcggcgttgactaatggaattacccgttttgatactgctcccagttatgctacagaagaagttttgagtcaagcagtccaacagtcggcaaacgagttggggctgaaaagatctgactatcaaattcaaacaaaaatagatcctattcagatgtataatgggaaagtagtggagtatttcaagagaaaactggagactatgcgattggattatatcgattctttgttgattcattggccggtgttgaagtatttgaaccctacatgggaagagctggtcatgctgaaagaacagggattgactcgaaagattggtatatgtaatttgcggatcaatcatttacaagagttaaaagttgcgcatatcataccggagattcttcaaatagaaagacaccccttgaatatctttgataaagaggtgttattctgtaaagaaaatgatatcgttcttcaggattattcacctttatgtaagatgcatcccaaattgaaggagtcggtactgctccgtgcgttggctgataaataccagaaagatataggtcaaattatattaaaatggcatatcaatacaggtgcaattcctatcttcacatcaaccaaaccgcagcgaatttccctttatgctcatttggatgattttgatttggaggaatttgaattgtctatcatatcttcgctaaacgataattataaactctatttggaatcattagtatgtcctggattttaagaaataaaaaggaagtaatcataactttactatggagcatattggttatgtttgcttttacacctttgtggttgttctccatatttatagctatcttcttcttggctttggctgtaaataatcgcttggtcctaaagttttacgaagctcataaagccttgtcacctaagcggacgattcctctttattctactatagtgataggtgatttatgtaatgtgagtgcttataaaaagtatttgagcgacaatggtaaaactttaatgataacagccccaagaagaagtctggaggcggattatcaaatcttgcttcactcagtctctgccttacatgagaatggaacatgtattatcataggatctaaatatgataagggtatcagtttgtttgatgtgccttatttaagtttgacgacacggaaggaattaaaggtagagactctgcttcgcagatcgcattatcctctattctttgagcctttgcggagcttgttatattttgtttccacaaacgacaaatactatctgaaagaatgcccacatccagatatgaggaaattctgtgataaaagaaatattcacttagtgtacttaacgacagaaagataacaattaattatagctattaaaatgaataacaagtattattcttcggagagaaatgtacaaattctgttggctttattgaagaggaatggaataaagaaggtgatagtttcacctggtggtacaaatatctgttttgttgggagcatacagaacgatcctttcttcgagatatattcttccgtagatgaacgatcagctgcttatatggcctgtgggttagctgctgaaagtggagagcctgtggttctttcatgtacaatgtctactgcttcaagaaattattatccgggaatgacagaggcttattatcgaaaactccccgtcttagcgataacttcacatataggatctaatcatattggtaatctacgttctcaagtgatagaccgacgtataatcccgaatgatgtagctcaaatgtctgtagagctaccaattccaaaagatgaaagcgaagatttttttgttgagatggaagtgaatagagctattcttgcattaaagaattttggctctggtcctgttcatatcaatttaataacaacttgcaatcaagattttaccatcaaagaattgcccttggttcaaactattcgtcgttaccaagcatgggatcagttgcctgagatccctcaaggaaaggtcggtgtttttgttggtgttcatcgcaagtttacggagagtcaagtatctgcaatcgaacgtttctgtgcgactcatgatgccgttgttatttgcgaccatacaagcggttattatggcgagtatcgattgcagcccaccttggttcaattacaaaagaatgctgaatcacccttggatgttttggatttgatgatacatataggcgaaacttctgcggctacttttgccggcactattcaaacaaaagatatttggcgtgtaagcgaggatggagaagtccgtaacccattcaagaaattgtcaaaagtcttccaaatgtctgaagagatgttcttcacggcatacagtaaaaagggagccgataaacatgattttatagatgcttgtcgtgagaaatgttatgctatctatgaacaaataccggaattgccattcagtaatatttggacagccatgcagctatcttcacgtttgcctgaaaaatcattgttacatatcagtgcctcaaatactcgtcgatgttggaatatctttccattgccggaaacggtagagtcttcttgcaatgtgggttgttgtggcattgatggttgtaccagtacattgataggggcatcgctggtgaatcccaaacgcttgtgttatttagtgaccggtgatttggctttcttttacgatatcaatgtgcttggtaatcggcatgtgggtaacaatgttagaatccttttgattaacaatggggtaggaactgagtttaaaatgaattcgcataattcttatatggcttttaaggaagatgtgaatgagtatatggcggcagaaggtcactttggaagaaaatctccttgcttggttaaacattttgctgaagatttgggatttgaatacttgaccgctagtacaaaaaacgaattcatgcaagcgttggataagtttacaaatcctagcttgtctgataaacctattatatttgaggtgttcactgatgccgaactagaaagagaggcacttgaaattatgactactcttgattatgatgctaaaactttagcaacccataaactgaaagaaacagccaaatcagtattgggaaaaaatcttataaatacaattcgtaagttcagcaaatgagaataggaatactaacctttcattgtgcccataactatggggcgatgttacaatgttatgccttgcaggaatatttgaaaggtcggggagatgaggtgtatgtgatcgattatcggccggactatttgacacatccatataaaaaacataaattgtctcattggctttccaaggatccgttgcgtacactcaagcgtttgctgtccgagccattcttattgaaaaaaagaggcaaacgttgggatggattcgataacttcatgcggatgaagcttaacctgtacccctacgatatgagttcggattattccaattttgattggctgttgtttggtagtgatcagatttggagttctcgtctcacgggaggtcggttcgatccggtattttttggacaaggtgttaattgccgtaaagctacctatgcggcgagtatgtctcctatatgtttggatgcggcagagaagaaggtattgccctccttattgagagattttaatgctatatctgtgcgtgaagctgaattggcaaagacactccatccctttacaggcaaggaggtgcatgtggtgtgcgatccagtattgctattgaggaaaaaggagtgggagaaaaggtgtgtgccaatttcaacgaaacgcccttatgtgctttgttataatttgttgcaatcagagaagtgtgcggaacaagctcgtaaagttagtcgagagttagggtatgagctgataaatattaccgcttgtttacttccgttcaaatcggggcggcgttatttacagacacttgaccctatttcgtttatctcttatttcaaagaggctgcatttgttgtgacatcatcttttcatggtacagtgttctctgttgttttccaaaagcccttttatgtggttgggatgggtagtcttggagggcgttccgcttctttattggctaagttgaatttgtctgatcggatattgggagaagtgacggatttccttgatggaaagattgactatgagagggtggagtttttgttagagaattataggatggaatctgtcgattatttaaaatttgatgaacataacgattaaatatgatttaaaaaataatcgttatgattatttgataatgatgacgattgtgtcggttatatttgcgggtccattgtttggtgcatttattccgacacgaataataggttttttgtttttgctctattatattattaaaattaaggttaattatcggatcaagaaattaacctattgcttatatggagttatcttttattcgtttttagctgtattttggatatcggattggtatatgtatacaacctcttttttgagtttattatgttatataggtgctttctttcttatttattattcttcgtttagggctagtaaacctattgattcaatattaaaaggatggttgttttttacaatagctaatttggtggtagctatttgggaagtctttaccggtcaacatacggcagaaggacaatttcaagcaacagagtatgcgacatctttagatggtacggtgggattgagaacttatgccgctgtaacttatggtaattacaactctttgtctattgtgctgattttatgcttgtttatgttgatactttattgggtatatacaaatgtgattcgtgaaaaactattattgcttcttcttttattatttattgttgcgatagaatttattaatacatctcgtggttgtttgatagctctgtttctttcttttatcccattttttatggggatgaatagtaataagagagataaatatattttgatctttgtattgtctatattatgtgtctatctgtggtatgagtattcggatactattctttttttaatagaacgaaagactgatgcgagaactggagcagctcaagatcctcgttggattttatgggctggaggattgaaaatcgcagaggattggttatatataggaagtgggcctggaagtcaaatttatgaatatgagaaagcggatatttggattacctatgctcataatttgtggattcaagcattggtcgaatatgggttagtatttacgattgctcttatttatggtgttgctagattagctattaagtgctatttggattctaatcgtttgttgcatttaataggtgttatcctaattctttgctggccaatattgacaattgtcgatgaagggtacttaaaatcgtttcattggacgttttttgcctccatacttgccatataccatttaaatcaaactaatcaatttcaaatatctagatgaaatccattctcttctttcatcctaagaacgactacaccgggagtactcgtgtgttagctgatgtgattgctcgtgattatgcggggcaatctgttgatatcattgttaaccggaatcatggcaaaggattcttgagtgaattgccaaatgtgcaattgatagggtattgtgtacctacttggcatggaaagcgtatccctgttgttgcgccattggtatggcgcatacattttgtgttgcttacgttatgtttaggttggcgttacaatacattttatatcaatacgatcactccttacttggcagctctgttaggacggttgtatggaaagaaagtaatctatcatattcatgagaaatttgtccagcaaacgctatctgttcggataatggagtggatatttgcccatacaaaggcacaccgtattttcgtgtcgaggtatacgagagatagctatccagataatccatcgtgcacgagtacggtgtgctacaatcatctaggcaaacaatttttggacagggtcgatataaagcctattggtgagcgaaagcggaatacggtcttgatgattgcctctctctcgaaagtaaagggcttatctaccttcatggcggtggccgaacttttacccgatctccatttccgcttgatgcttagtgcggatatggaatctatacaggcttatttagaacagtcaatacctaaaaatgtggaattaattccagcacaatcgaatatccatccttatttacgagaggcggacttgatgctcaatttatcaaacccatttttgtgcgtagagacttttggtatgaccattttagaggcgatggcttatggcgttccatccattgcgcctaacatcggagggccaatagaattgatagaagatgggtataatggcttctgtgtggatgtgactgatgctaaggtcgttgcggaaaagattaaggaagtgctggggcttgataattatgagcgatttgcggataacgcactggctggatttgaacgatttcgctagtagttctgtatatcaattaattgattcgattgtttatattctttcaatgaaaaaaatagttgtgcttctctccacctataatggagagcgttttttgtgtgcccagctggatagcttgttgatccaagagggtgtggagttgaaggtgttggtgagggatgatggttcctcggatagtacatgggatttattgatcgcttataaggatttgctttccgaagaggctgtgtggcttatttctcgttttgttttttcaagaaagaattggcttaccagattactcttattgctcgatggaaagattaaatataacggctttgaatccaatctcttttatgtgttaaaaattatcaagggaggtgtagggcttcctctattttctcatcgggcgcttacgccatttgtagtgcgtgagggcttatgagagaatcagtggcgatagttgtcgtgttgtataaggcggagatgagcgtttatcatgaacgtttattggaggatgagatggttacattggtcgtagtagataatacgcctgatcgggatttggcattaaagaaggatcggttgatatatgttcctctacagagaaatatgggtatagctactgcacagaatgagggaatccggcaagctgagtgtttaggatgtgactatattatttttttcgatcaagatagtaagattcccgaaaggtattcggaaggtataatagaagaatataagcggatcgaacaattgattcctaatctgtttttgttgggaccaaccataataaatggccgtacagaagaggagtataaatcaactatccataaggatatatggatgacggaagattttatacggagacgggagattataagttctggaagttgtgtttccctgcggaaaatagaggaggtgggattgaatgatgattctttgtttattgattatgtggatcatgaatggtgttggagagcggagagtaaagggtttgtcaatggcatcaccctaaagattaaacttgctcattttgtagggcaacaggagtaccggatattcaaccagcttgttatcatttcagccccgatacgatattattatcaaacacggaattatttatggttgcttcggcgtagttatgtgccaaggcaatggaaaatcaatcatggaataaagttaatgatatatccgatttctttccctttcaaggttaggtgttggcgagcgatttatgtgcaaatgtttagaggtttaaaggatggattattaaataaaaggtatggtaaaagtaggagcggtagtggtattgtataacccgaattttgacgtgacaaagaaaacattgtcatcattggctagccaggtagatcaaatatgcgtggtggataattctccatctgaccactctgaggtgctgagcggttatgagtcggtggagtataaaccattgctgaagaatataggtatagctgcggcacagaatataggcatccgttatttcattgatttaggttatgacttcgtactttttgcggatcaggattcgattgcgtcagagaaagtagtggacaaactattagagaatcatcaagcgcttaaagaggccagtataaaagtcggtgcagtaggaactcgggcaattaatcgtcaaacaggactaccatatgttgaaaagtctaatgagattagaattatagataaaagagtattgagtaatacttcaaatattacggagtgttattctattatgtcatcaatctcattgattccttgtaaagtatttaatattgtaggaggttttgatgaatctctttttattgatggtgtagataatgagtggtgttggagagcttggcataagtgtggtttgagatcttttatagtggaagatgctgagattggtcatatgctaggtgaaggagatagattttttttttataaaaaggtggctattgcttctccgtttagggtgtattatcagtttcgaaattatttgtggctttgtcgaagggattatgtgccaaggtattggaaaaggaaaaatggtatgaagtattttgtgaaattgttttatttcccgatttgtgttgctccgagaacgatgtatttacggcgcattgtacgtggggtgataagcgggttgaatccagtcaaacctaattggcctattttcttgatgctgagtagtttgttaagaatgtttaaggagggatgaatacttgatagtaaacagaatacaaaatagtaagaatttaattgtctcatcttattcatcgtatgcgtgatgggtaagatttcggtttgtatggctacctataatgaggcgaagtatattagggaacaattggaatcaatcttgtgccagttgtcggaagatgatgagattattgtatcagatgatggttctactgatgggacaatagatattattatgtcttatcatgataatagggtaaaagtattacatcatatttcttcccctggttcttcatttgtgaaagctacgagaaattttgagaatgctttattgcatgcgcatggtgattatatttttagcagatcaagatgatgtatggcataaaaataaggtgagtgtttgtttttcttatttagataatatatgttgattcaacatgaccgaacacttataggaaattcgtatggctatcctttgcatgtgaaaagcatccataaattattttttttgaatttgtttgatttatcgttcaaaggatgttgcatagcttttcgacgagaattgttacaaaaagtattgcctgttccaaagccagtgattgtccatgatgcttggattggctgttggggttatttgttgggtagttatgtctcgataaatgatgaactgatagattatagagttcatggaaaaaatgtatcaataggtacaaggaataggttttactataaaatattgtatagactgcaaatttgttattgtttgtttaagcgttcatttttctaaatgatgagacatacgatagtttgtattgtagcttgtttccttgtttttaacgagtgattaaaatctttttttattttgattcaagatgtgttctgattggaacactaatggttaatcaattttccctatattttatgcaatcattttctgtattgctttccttatatcacaaggagagtgcattattcctgcaccaaagtctggagagtgtctttgcacaaacactattgcctaccgaggtgattttggtggaggatggacctttgtccgaagagttgcatgcggttgtaaaagagttcatggatcggtatcttgaattaaaggtgattcctttggtagaaaatcaaggtttggggaaagctttgaacgagggtttgaaacattgctcgtatgatatcgtggctcgcatggatacggatgatgtggcgaagccagaccgttttgaaaagcagttggcgatatttcaggaacatccggaagtggatgtagtgggagcttggatcgatgagtttgagggagcggtatccaatgtcctttctgtgcgtaaagtgccaaaggatcaggaagatatcttgagatttgcaaaaggaagatgtccggtgaatcatcctgtggtgatgttccgaaagtcggctgtattgaaagctgggggatataagcattttcctttgttcgaggattattatttatgggtacggatgttgatggatggtgctcgattctataatattcaagagagtttactttttttccgtttttctccagatatgtttaagcggagggggggatggaggtatgccgtaacggaggtgaaattacagactctgttttataggataggttttatcgattttttctccttaataagaaatatctgtattcgtttggtgactcgtcttctccccaatgactttcgctctttactttataagagatttatacgaaattaaattattctttcgctttatttcgtatatccgtacggtgatttcccaaagcttttttgtgttagagatcccatggtaaggcctcccctaaaaggaggcttttttgtttccggaaacatcgcattatgacttccggctttgttgtcatctatgattttaatcttatctgtgtatcaataaaatacaaattcccatctataccataaagcacattgttaggggctgcgtcaaacacttcataatcttcattgtggtattcgtcgtaatagtccattttaaagccaagagcttgcatataggcggctatttcatcttctgtagcttctcgttccgctaatatataaggttgtatgaggactgcacagaatttttgctcgctgttatatgcgaagccaatcatctgataaggtacattactgaaaaacttgttatgtacagtaatgcgaatgaaaaagttctccaagtcatcaccagcgtactcaaagttatttagcttgattacagagaccttaccatcatgaaatacttcattctcaccacctttgtccatataggtgagagtgaggcgggataagttaacccatagatttctattattagtaaattttattagctcattgatttgccttctcttatagccctctgttggttcaatctctcctgctgtttctttacttcttctggcgatgcaggctgcttgctccaagaggttattgattggcgagtacgctctatccattgtttgtgaaattcgttaatatattccataaatcattttactaagagttcatggcaaaggtaatctttctattttaatatcgtaatgatttgtctgtaactttgtaaggttacattataaaaatgtatggagagtttacttcatgcatattgtaaatttccagtcggctaagaatggaatgtattgcctgaaacattatgcctcccttctttgttatatcttattatggattgaaaacaaaccctcccttttgcttataaaatgtaagctttgttaaccaaacgtccgataaaaacattttttccgtgaaagtgtcaattattttatgtttgtttaaacaatatgttaggtattgtctgtatctttgcggcaaaatcaaaaagttgattcgacaatggaagtattgaagcacgagtgtggtgttgccatggtccggttactgaagcctttggagtattatcacgagaagtacggtagttggatgtatggactgaacaagctctatttgctgatggaaaagcagcataacagggggcaggaaggagcgggcttagcctgcgtgaagttagaggcaaatgccggagaggaatatatgttccgtgaacgggccgtcgggaccggagctattaccgagatatttgccgcagttcacgaacactacaaggatttaacccccgaacaactcaacgatccgttattcgccaaagccaacctacctttcgccggagagctttatatgggccacctccgttacagtaccaccggaaaatccggaatctcttatatccatccttttttacgacgcaataactggcgtgcaaagaaccttgccgtttgcggaaatttcaacctgacaaatgttcatgaggtattcgaggagatcacggcgatcggccagcatccccggaaatattccgatacgtatatcatgctggagcagctgggacaccggctggaccgggaagtggagcgcctgtaccaaaagtgtgaggcggaaggattgagggggatggatatcacgcatgccatcgaggatcaaatcgatttgtcgaacgtgctgaagcgctgtaccccgggctgggatggtggtttcgtgatttgcggtatcaccggtagtggcgagtcgtttagcgtacgggacccgtggggaatccgtccggccttctattatgcggatgatgagattatcgtgttggcttccgagcgtccggttatacaaaccgtgatgaacgtgcaggtagagaatatccgggagttgaatcgaggagaggcgatactcgtcaacaagaaaggcgagtggcatatctcccagatcgtggagccgaaagagaataaggcttgttccttcgagcgtatctacttctcacggggtagcgacgtggatatttacagggaaaggaagcgtttgggagataatctcgtgcatccgatcttgaaagcggtggattatgatttgaatcataccgtcttctcttttatcccgaatacggccgaggtcgcttatttcgggatgcaggagggattgaacaactatttgaataagctgaaaaaagaatggatcgccgatcgtagtcacttgctcagggaagaggaactggagcaaatcctttccatgcgaatccgctcggagaaagtagctataaaagatataaaattacgtacatttatcgctgagggcaatagccgcaatgatctggcggcgcacgtgtatgatattacttacggaagtattgaaccttttatcgataatctggttgtgatagatgatagcatcgtgcggggtactaccttacgccagagtattatcggtatcttggatcgcctgcatccgaagaaaatcgtgatcgtaagttcttctccgcaggtacgttacccggattattacggtatcgatatgtcccggatgaacgagtttatcgcttttaaggctgcggtggccctgttacgtgaccgggggatggaatacgtgatcttggacgcttatcagaaggcgaagcgacaacaaacagcggcggatggtccgttggtgaattacgtaaaggagatatacgccccgtttacggacgaggagatatccgttaagatggtggagttgcttacaccggccgggacacaggcgaaagtagagatcgtctaccagactttggagggcttgcatgcctcttgtccggagcatccgggtgactggtatttctccggcgattacccgacaccgggcgggactcggttagtgaacgaggcttttattcactatatggaagaagaatatttagtgaaatgacacaacatacagattctatgcagacaaacagaacagcaactttgatgttagacgacggtaccgtcttccgtggctactctttcggctatgagagaccggtggctggcgaggtcgtgttcaataccgctatgaccggatatccggagagcttgacggacccttcgtacgcaggccagttgatggtgttgacttatccgctcgttggtaactacggtgtcccgcctcgtacattcgagccgaacgggatcgctacgtttatggagagcgagaagatccacgccgaggcgattatcgttagcgattacagccatgagtatagccactggaacgccgagtgcagcttgggcgagtggttgaaggaggagaagatcccgggcatatacggtatcgatacgcgtgcgttgactaagaaattgcgtgagcatggcgtgatgatgggacgtatcgttatcggcgatgccgataacgaaattggaaatggagaattgaagatcgaggattatgagcatgtgaactatgtggatcgggtatcgtgcaaggagattatttgttacctgcccgatggtacgagccagacctgttctttattggaagcctccgattcccgattctcgattctcaattctcaattcctaaagcgcgtcgtgcttttggactgcggcgtgaaacataacatcatccgttgcctgttgaggcgtaacgtggcggtgatccgtgtgccttgggactacgacttcaatcagctggaatacgatggcttgtttatcagcaacggtccgggcgatccggatacttgcgatgccgccgtgcggaatatccgtaaggcgctttccggggataagccgatttgcggtatttgcatgggtaaccagttgttggcgaaagccggcggtgcttctatctataaattgaagtacggtcatcgtagccataaccagccggtacgtatggtaggcacggagaaatgcttcatcacctcgcagaaccatggttacgccgtggataacgatacgctgggtgaggagtgggaaccgctgttcgtcaatatgaatgacgggacgaacgagggtatcaagcataagacgaagcctttcttctcctctcagttccatcccgaggcttgcagcgggccgctggatacggagttcatgtttgataaattcacggaattgttgtagccggggatttacgcccaccctaaacgagggattagggcaaccctaaatgagtgtttaggtctaccctaaaagagaacattaaaaaaagtaaagcaatgaaagaagatataaagaaagtcctgatactcggttccggagccttgaagattggtgaggcgggcgagttcgattattcaggcagccaagccctgaaggcgattaaggaagaggggattcaaacggtattgatcaatccgaatatcgctacggtacagacctcggaaggagtcgcggacacggtttatttcctgcccgttactcctttttttgtggaaaaggtgatcgagaaggaacgtccggaaggtatcttgctcgctttcggcgggcagacggcgttgaattgtggcgtggctctttaccaaagcggcgtgctggagaagtatggcgtgaaggtattgggtaccccggtgcaggctatcatggataccgaggatcgggagttgttcgtacgcaagttggatgagatcgacgtgaagacgatcaagagcgaggccgtggagaacgccgctgacgctcgtcgtgcggccgctgagctggggtatccggtcatcgtccgtgccgcttatgcgctggggggcttgggttccggtttctgcgacaatgaggaagaattggacgtgttggtagagaaggctttctctttctctccgcaagtattggtggagaaaagcttgaagggctggaaagaggtagagtacgaggtggtgcgcgaccgcttcgataactgcatcacggtatgtaacatggagaatttcgacccgctgggaatccatacgggagagtctatcgtgatcgctccctcgcagaccttgagcaatacggattatcataaattacgtgagttggcgatccgtatcatccgccatatcggtatcgtgggcgagtgtaacgtgcaatacgcttacgatccggagagtgaggattaccgggtgatcgaggtgaacgcccgcttgagccgttcttcggccttggcttctaaggcgaccggttatccgttggctttcgtggccgctaaattaggcttgggctacggtttgttcgacttgaaaaactccgtgacgaaaacgactagcgctttctttgagccggctctcgattacgtggtatgtaagatccctcgctgggacttgggtaagttccacggcgtggctcgtgagttgggttccagcatgaagtcggttggcgaggtgatggcgatcggacgtactttcgaggaggctatccagaagggcttgcgtatgatcgggcagggtatgcacggtttcgtggagaataaggagttggtgatcgaggatatcgataaggctttgcatgagcctaccgaccgccgtatcttcgttatctcgaaggcattccgagccggttatacggtagaccagattcatgagcttaccaagatagaccgatggttcctacagaaactatatggaatcatgcagacctccaaggagcttcacgctttcgatatgaaggggatccaacgttggcgcatcaatccggagttgatccgtcgggcgaagatacaaggtttctctgatttccagatcgcacgggcgatcggtctcgacggggatgtggagaagggtatgatgttggttcgtcagttccgtaaggagcatggcattcttccggtggtgaaacagatcgataccttggccgccgagtatccggcgcagacgaattacctgtacctgacgtatagcggtacggaaaacgacgtgacgtacttgggcgatcatcgctcgattgtcgtgctgggttccggcgcttaccgcatcggtagctcggtggagttcgactggtgtggcgtgcaggccttgaatacgatccgtaaggagggttaccgctccgtgatgatcaactacaatcccgagacggtatctaccgactatgatatgtgcgaccgcctttatttcgacgagcttaccttcgagcgtgtgatggatatccttgagctggagaacccccacggcgtgatcgtctccaccggcggccagatcccgaataacttggcgatgcgtttggacgagcagcatgtgaatatcttggggacatccgccaagagcatcgataatgccgaggaccgtgagaagttctccgccatgttggatcgtatcggcgtggatcagccccgctggaaagagctttcttccatggaggatatcaatggcttcgtggcggaggtaggcttccccgtgttggttcgcccgagttacgtgctgagtggcgccgccatgaatgtctgctcgaatcaagaggagttggagcgtttcttgaaattggccgccaacgtcagccaaaagcatccggtggtggtaagtcagttcatcgagcatgcgaaagaggtggagatggatgccgtggccgatcatggcgagatcgtgatgtatgccattagcgagcatatcgagtttgccggggttcattccggcgacgctacgattcagttcccggcccagaaattatatgtggagacggttcgtcgtatcaagcgtatcagtaagcagatcgctaaggagctgaatatctccggcccgttcaatatccaatatctggcgaagggcaatgagatcaaggtgatcgagtgtaaccttcgtgccagccgttccttcccgttcgtgagcaaggtgctgaagataaacttcatcgagttggctacccgtgtcatgctgggcttgccggtagagaaaccgaataagaatgagttcgatttggattacgtgggtatcaaggcctctcaattctcgttcaatcgcttgcagaaagccgatccggtattaggggtcgatatggcttccacgggcgaggtgggttgtctgggcgacgatgtatccgaggcggtgttgacgagtatgctcgctgtcgggcaacgggttccggagaagaatatactcctgtccaccggtacgccgaagcagaaggtagccatgctggatgccgctaagatgttggcgacgaaaggctacaacctattcgctacgggaggtacgcaccgtttcttggcggagaatggcattccgagtacgaaggtgtactggccgagcgagaagggagaaccgcaggcgcttaagatgcttcatgagaagcagatcgatatggtcgtgaatatccctcgtgacctttccgccggcgagcttgacaacggctataagatccgccgtgccgccatcgacctgaatatcccgttgattacgaatgcccgtctggcgagcgctttcattcaagccttctgtaccttgagcgtagatgatatctgcatcaagagttggcaggaatataaataaatgggggcttgatgtaaatcaagtggtatttatttcgtaagtttgcggaaacaaacaaaaacaaccatgaatatggatacagcgatatttatagctcgcaggattgcggcgcaatcgattctactcagtgaggaagccgcccagaaactggcctctatcttaatccggacagaattgaaaaaaggcgccctgtttttgagcgaaggagaggtttgtacgcaactcggttatgtctataagggaatggttcgccagttttacttcaagaataagaaagagctgaccgagcatttcgccagtgaggacaacatcttcatttgcatcgagagcttcttgcgccagcgtcccgctaatctgttggtggaggccttggagaatacggtgctgtatggcattcctcatgatcctttattggcattgtgcgccgaggattacgagatcgaggtcatgtatcgccgcctgttggagaattcgctgatcctgtctcaacggaaggcggatttccttcgtttcgagaccgctaatgaacgttatgcccgcttattgaaagaacaccctgagatcgtgcagcgtgcccccttgtcccatatcgcctcttatttgctgatgactcccgagacattaagcagggtaagggccaatatgcagctatgaggggcttgtaggtgttaattatatacggtgtcgtatatgatatataagataaaattagtatgaaggtaggattatttatcccatgttacattaacgcggtgtaccccgaagtgggtatcgcctcgtataaattgttgaggcatgtgggtgtggatgtcgattatccgatggaccagacctgttgcggacaacccatggcgaacgccggcttcgaggatgaggcggctcgcttggccctccggatggaggaacagtttaagaactatgactacgtggtaggcccctcggccagttgcgtagccttcgtaaaagagaaccatccccatatcttggagaagcgggatcacgtttgtatgaacagtaagaagatttatgatatctgcgagttcttgcacgacgtggtgagaccggaatccctgccggccgttttcccgcataaggtgagtatccataatagttgccacggggtgcgtgagttgcatctctcgtcgcccagcgagcgtaatatcccgtactattccaagttgcgtgatctcctttccttggtgaagggtatcgaggtgttcgaaccgaagcgggtggacgaatgttgcggtttcggcggtatgttcgccatcgaggagcctgaggtctctacttgcatgggacaagacaaggtaaaggatcatatgagtaccggcgccgagtatatcaccggggcggatagctcttgcctgatgcatatggaaggggttatcaagcgagagaaacttccgatcaagactattcacatcgttcaaatattagcgtccggattatgagtacgaaacatgctatagctgcggcccgtttcctagagaataaggagaatgaggcttggcacgaccatacgctttggatggtacgtaccaaacgggataagatgagccattcgcttcccgagtgggaacggttgagggagttggcctcggagatcaagctttactccaacagccatctggacacgcttctggaggagttcgagaaaaacgcgatcgccaacggggctatcgtgcattgggcgaaagatgccgaggagcataacgagatcgtcttgcggatcttgcgccagcatgatgcccggaacctgatcaagagcaaatcgatgctgacggaggaatgccatatgaatgagttcttgatgtcgaaaggaatcgatgtggtggagagcgatttgggtgagcgtatcttgcaattgatgcatttggccccgagccatatcgtgatgccggcgatccatatcaaacgggagcagatcagcgagatgatggagcgtgagatgggaacggagaaagggaatatcgaccctacctacctgacgcatgccgcccgtaagaatctgcgtgagaaattcctccatgccgacgtggcgatgacgggcgctaacttcgccgtcgcctctacgggcgagatcgtggtttgtaccaatgagggaaacgccgatatgggaacctccttcccgaaggtgcatatcgctacgatggggatggagaagatcgtaccgaatctggaggcattgggcgtattcactcgtttgctggctcgttcgggtacggggcaacccatcacgtcttatacttcccattatcgccgtccgtccgagggacaagagttccatatcattatcgtggataacggacgtagtgatatcttggcgaaaccggatcatattcgtacgttgaattgcatccgttgtggcgagtgcatgaatacctgtccggtatatcgcaggagtggtggctattcgtatacgtatttcattccgggaccgatcgggatcaacttgggtatgctgaggaatccggaggaatattcggataacgtatcggcttgctccttatgtctttcttgctcgaacgtttgtccggtaaagatcgatttgggcgagcagatttaccgttggcggcaagatttggataagatcggtaaggcgagcaaggagaagaaagtgatgtctttcgggatgaagttcctgatggaacgtccgggattgttcaatacggcgttgaagtttgctccggtagcgaatcatttgcctcgtttcatggtctacaatggcttgaacgcttggggcaagggacgtgagcttccggctttcgccaaggagtcgtttaatgatatgtggaagaataataaggtgagataatgagtagtaaagattctatattggcgagtatccgtcgtcatacgggtgcacgccacgagatgcctgagcttacgttggaggcgattacctatgcggataagttggctacgttctcggaggtgttagccggggcgggtggcaaggccatcgagttaaagcccggcgaggatgtgaatgaggtgatccgccgtgagtttccggaggcgaaacgtatcgcctcgaatttgaaggagattacttgcgctacctttaacccggatgagctgaccgatccccgggagttgaacgggacggacgtatctgtggtggagggtagtttcggcgtggcggagaatgccgctgtctggttaccccgtcaggtacgttataaaggtctgtactttatctcgaacgctttggtgatcttgttggacaagactcaattggttcatacgatgaatgaggcttaccgccgtactgccactatggattatgattacggagtcttcatgtccggtccctcaaagactgctgatattgaacaagccttggtattcggggcgcatggcccgatccaagtagtagtcctgttaagataaaatctatacccttttgaggggatgagacggggcacgccccgtctctacaagttgtacgttatttacagctctccaatatttcccgtgccacgctacccgttacattcttcgcctccccgaaggcggcgtttcgttcattgaagcgattctcgatctcggtgattgtcgtatcgccgatcttctcttggctgaggcgggtagataaaccgaggctttggaaaaattgctcagtcttctcgatggcttggcttacccgttcctctgtcgttccactattgataccccatacccgttcgccgtattgcaggatcttgccctctttctgcttgcgaagggtgcgtaaggttccggggaagacgatcgctaaggtcgctccatgcgtcaatccgtgaagggcggttagctcgtgtccgatcatatgggtagcccagtcctgcgttacgcccatagcgataaagccgttcaagcccatcgtggcggatagcatgaaatctgccatcaggtcgtaattcctcggatcttccttgatcttcggggcgatctcaaccaaggtgcttaaaatactttccgcccaatgatccatcaagcgggattggtcggtcgtagtcatatattgctccatcacgtggacgaaggtatcggcgataccgcaagccacttgatacgggggcagactgaaggtcgtctccggatccaagatcgagaatacggggaaattgctgtagaacgggaatttctcttgcgtctctttccgggagatcaccgccccgctattcatctcggaacctgtggcgggcagggtcagtacggtacccatgggcacagtatgatagtaataccctttctgcaccaattcccaaggatcgccgtcgtactgggtgccggcggagattaacttcgtcccgtctatgacggagccaccgcctaccgccaatagaaaatccacctgcttgcctttcgctatctggatagcttctcgcaaggtctcgatggtgggattaggctcgatgccccagaactcgatatagtcacgatcctttagcgccttgatcacttggtcgtacacaccgttttgctttacgctacctcctccgaaggtgatcatgatgcgatgcaccatcgggatggccgtactcagtttctcaatcatgcccttaccgaataataaacgggttgggttgtgaaaagtgaagttattcataggactatttactgtttttatatgtaaacatgaatagggttcctattgttttagggcttccagtaacttatcgaccgcctcggcgggagtagcttcgctctttagtaactggacgaacttgctaccgatgatggcaccggaagaatgggctgtcgccgcctcgaaagtggctttattgctgatgccgaaacctaccaagcggggattctgtaggttcatggcgttgatacgacggaaataggcctgcttttgttcgttgaagtcttgttgggctccggtcgtggcggcgctggataccatatagataaatccgctggtatgggcatcgatctgccggattcgttcctcggaggtctctggggtgatcagcatgatcatttttaggtcatggcgatcggcgatctccttgtaatcggagatataatcggcgtaaggcaggtcggggatgatcattccgtctacgccggcctctacgcaactggcgcagaatttctcgaaaccgtattgcatgatgggattcaagtagcccattaggatgatcgggatctgtacttcgctccggatctctttcaattgctcgaataggaggtggagtgacatcccgttacgcaacgcttgcgtggcggcctcttggatgacggggccgtctgccatcgggtcggagaaagggattcctacttctaccatgtggatacctttagcctgtaaggcttttaagatgcttgccgtatcgtttaagttcggataaccggcggtgaaatagacggagagtattccgtctttctgggtctggaataagtttgtgatgcgattcattttgaattctattttaaaaatactatcagacggtgggagacggggcacgccctgtctctacagctggatgtaaaatttgttggatgaaattctttagtttgtcgacgtctttcaatcccggctcaatctcgaagccactgttgaggtcgatacctgcgaaacggggatgccggaagttccggatcgcctctgcgttttccggacggatgcctccgctgagcaagaagggagtctctcctttatattcggttaggatggaccaatcgaaacgtttgcctgagcctccatagccctcgcatctcgtatcgaaaaggaaataatccacccggccctcatactcccttgttttttcgaagtcctctttcgtagcgatggggaaagccttgatcaaggaatagccccttttttgcaaggtgtggcaatcttccggcgattcgttaccgtgaagttggagatagtctagcttgtaggcggaggctttctccatcatggactcgatggtagcgttgacaaaaacgcccactttcttaggggacaattgttcactgtccgttacctgctgctccgtcgggcatcgctcgacaaagcgcttggaacgttcgtagaagataaagccgatccagttgatggctagggcggctacttcccggatattctgaggctcccgcattccgcaaactttgatgatcatgccagtcctcctataaaatcggctagggtatcgcccggcctctcggttttcatgaaggtctctccgatcaggaatccacggaaaccggcctcacgcaattggcgtacggtatcggtctcggatattccgctctcggacactaaaagaggggagaagcctcgcatcttatcgaccaacttgaatgagttgtttacatccgtatgaaaggtgccgagattacggttgttcacgccgagcatatcgatatccgcgttcaggtatttgagctcgtcctcgctatggacttccagcaagacttccaattgcaggctatgggcggtctcggcgagtatccggcattcttcttccgtaagggcggcggcgatcaacaagacagcgtcggcgcccatcacccgagcttggaagagttggtaggtatcgatgatgaagtccttgcgaagtaacgggagatccaccagcttgcgggccttttgcaagtcgcccaaggaacctccgaagaaatccccgtccgtaaggatcgagcaggcggaggcgcctccggcctcgtaagcgggcaccacgtcggcgatattcgcacccggatgcagccagcccttggaggggcttttacgcttgaactcggcgataataccggagggggatgattccagcgccgcacgcatggaacgtgtgtcacgctccatacggtcgctacctaaagccaataaggtctgtaagcttacggcctgtttctgccgggctacctcgatgcgcttattggcgataatatcttgtaagatgtcctttttcataggatatgtttctttatcaatggttcaaagatataaatttacggaatgtagccaatgcttttccgctttccagtgattcacgtgcctcggcgatacacgtctcgatctttttctcaggacagatcacttggatggcgaaggcggagttggcgatcacgcagctcttttgggcctctgtagccttgttccctaatacggcgtcgaagatacgggccgcttcctccggggtctcgccgccatcgaggtccgcttccgtgcaacgtttgaatccgagcatctccggggtataaagcttctctttctccggcatggctaccttgaaatcggccgtgagggagatctcgtcgtaaccgtccaagctatgtaccacggcgaaacgggtaccgctctcttgatacgtataattatataggcggagtagcgggaggttatatacgcctaacaattggtaagtaggcatgaccgggttgactagcgggccgagcatattgaagaagctgcgcacgccgaggctcttccgtaccggagctaccgctttcagcgccgggttgaacaagggggcgtggaggtaggcgatatggcaggtatccatggaggtacgtagcttatcgatatcgttcgtgaattttacgccgtgttgctccatcacgttgctggcaccgctcaccgaggtagccccgtagttaccgtgctttacgacatggtaaccggcaccggccactacgaaacaggaacaggtactgatgttgaacgtgtttttcccgtcgcctccggtacctacgatatcgatcggcttgtattcgcttaaatctaccggtacacgcatctccagcaaagcttcccggaatccggtcaattcctctacggaaatactgcgcatcaggaatacggtgatcagactggcgatttgggaatcgttgtagcgtccctccgctatattctggaggatattccgggcttcttcccggcctagatattggtgctcgaataatctgtataatatttgcttcatgtctgtaatgtgttgaatgataaaatattgcagttttgcgatatttctttatcgaaaaacttttgtttctctaggggaaaactcttgtttcttgcttgagaaacattagtttcactataggaaaactgatgtttcgttaggaagaaactataagtgccttaggaggtaattagcgtttcagccagttctctataattgtcttccctttgggggtcaacacggattccggatggaattggatacctcgtacatcgtactcacgatggcgcaagcccatgatctgtccttcttccgtatcgaccgccgtgatttccagacaatctgggaagttttccttggagaccgcccaagaatgataacgcccaacacgtatacccggttccagtccctcgaagataggatctttagcgacaatccgtatatcggagcaaacgccgtgatgcacgtcggtaaggtttatcaatgtggcgccgaatgcctcgccgatggcctgctcgcctaggcagacacctaggatgctctttgtcggggcgtactggcggatcaaggggaggaggatgccggcttcctcggggatgcccggtcccggggatagtaagatcttatcgaaacgctctatctcttccaaggagatcttgtcgttgcggtgtacctctacgtccgcacccagttccttcaatatatgtagcaaattgtaggtgaaggaatcgtaattatcaaataataatatcttcattttatatatattgttattgttgtagagacggggcgtgccccgtctcatcctttcaaaatggtaacttaaaatactatcagactgtgggagacggggcacgtcccgtctctacaaccagataattaattgattaatttctccgctaggtctatcgctttcttcaaggctcccagcttattgtttacctcttgcaattcacgctcatcgttgcttttagccacgatcccggctcccgcctgatagtaaagtatgttgccacggctgacgaaggtacggatcgtgatcgcttggttcaaatcaccatccagaccgataaagccgatacagccgccgtaagcgccccggttatgatgctcgatgtcggtgatcagttgcatggcccgtactttgggggctccgctcaacgtgccggcggggaaggtatcgacgtaggtttttaccgggtcgctatcggcgttgatctcgccgctcacgcgggatacgaggtggatgacgtggctgtagtattgtacctccttatagaaatccacttgcacgtcgtgggcgttccggctgaggtcgttgcgggcgaggtctaccagcatcacgtgctcggcgttctccttggggtcggctagcagggcctcggtacgctgcttgtctacctcgatattaccggtacggaaagcggtcccggcgatcggatcgatgctggcgtgtctgcccgttaccttgcaatgcgtctcgggggaagagccgaagatacggaaacctccgaaatcgaaatagaacaaataaggagaggggttgatactgcgaagagcccggtacaccttgaagtcgtctcccttgaacggttgctcgaagcgacggctcaatacgatctggaagacatcccccctgaggcagtgcttgatgccttggcggaccatcgccttgtattcctcgccggtgatcggggaggtctcgggacccgctgtctggaagttgtaggaggcgaagttacggttctcgatcagcgtaaggatctcttccaacccgctatcctcgccgtcttgaaccatctccaccagagtaagctcattcttgaaatgattgaagacaaggatatacttatataatatgtatagcatatcgggggcgtcgttctcctcgtgatgaacttccatgaccgggatgttctcaaaataacggacggcatcgaaagccgtgtagccgaataatccgcagaccttcttgtccgctccctccaccttgaagcggccgaggaaagcgttcatcgcctcgggtacgttatagtcttcggtgagcggggtaacctcacgggtctcgtccgggaaggtagccgtgcattccccgttgttgataccgatgctcgccaaggggcggagcgctataaaggaaaggctattctcgtttccgtggaagtccgagctttccaacagggccgattccgggtagatatcccgcactttcagatagatgcttacgggagtgtgaaggtcgcccatcaccttcttgcttatcgttttgaaagaataattcatgataatttataattaatgtaagtgtccatatctttatcgccacggcccgagacagtcagtaccaccacctcttccggcttgaagtttaccttggccaaggctcccaaggcatgggcgctttccaaggccgggatgattccttccaaacgggtcaactcgaaagcagcctccaacgcctcgtcatcatcgaccgctaggatttgcgcacggtgctttacggagaggttcgcgtggatcgggccgatgcccgggtaatccaagccggcggaaacggaataaggttcctcgatctgtccgtcctcgttctgcatgaccaaggtacgtgccccgtggatgatgccctctttacccaattggatcgtggcggcgctcatgccggagtggatgcccttgccgccggcctcggccaatacgatcttcacccgctcgtcgtccacgaaatgatagatcgtaccggcggcgttacttcccccgcctacgcaggcgatcaggtaatccgggtgatcccttccttccttctccagcagttgcttcttgatctcctcgctgataacggattgcagccgggctaccatatccggataaggatgggggcctaccgtagaaccgataatataatacgtatccgaaggatgacagcaccagtcacggatcgcctcgttcgtggcgtctttcaaggtcatgtttcccgaggtcacgggcacgacggtagctcccagcatttccatcttctgtacgttggcatgttggcgttccacgtctgtcttccccatataaacgatacattccatattcatcaaggcacataccgtagccgtagccactccatgctgtccggcacccgtctcggcgatgatacggctcttccccatgcggcgggctaggaggatctggccgatcgtattgttgatcttatgtgctccggtatggttcaagtcttcccgtttcaaatagatcttacatccgtatttctcgctcaaccgtttggccaagtaaagaggggaggggcggcctacataatcacgcaataactgatcgaactcttccttgaagctatcgctctccaacacttgcagataggtattctgtaaattttccacgcattgatgaaggatctcgggaacataggccccgccgaactcaccatagtaaccattcttgtcaacttgatacgttttcatcttttatctattttagttattttccttttgaatttgccataaaaagaaaagaggcctgccgcaagtgcgacagacctctttatatctttatgtagtgtttatatatacatacgagtcttcgttccttacgaccttttgagttgtacggagcgccaccaccaatatgtatttactacgaatgttctcatgactctgttttgttattacggcagcaaatatatggaatctttgacaaacagcaaataaaatcgtgttttttttatgaatgagataaaaaagatcagaaggtctattaaaactgctctattgacaaattgtaatttattgagccttgtatagacgtgtattggcgtttttggtatttgtttttattatttcgaagaataatttgctttcaaaataatagtttctacctttgcggaaacaataaaaaacgattaatatttctaatatggatactaaattaactggaaaaactcgcatagagagcgatttgatcggcgctcgtgaaatccctgccgaagcattatacggagttcaaaccttgagaggaatcgagaatttctcaatcagtaaattccgtttgagtgaatatcctttattcattaaaggattagctataacaaaaatggcggctgccatggctaactttgaattaggcttgcttaccgtagagcaaaaagacgctatcatcgccgcttgtggggagattctcgatggtaaacatcacgaccagttcccggtggatatgatccaaggcggagcgggtaccactacgaatatgaacgcgaatgaggtgatcgccaaccgtgccttggagctgatggggcatgagcggggtgaataccaatactgctcaccgaacgaccatgtgaactgctcgcaatccacgaacgacgcatatccgaccgctatccatatcggtatgtattttaagcatcttcaattgcttccccatttggaggaattgatcgcctctttccgtaagaaaggagaggagttctcgcagattatcaagatgggacgtacgcagttggaggatgccgtacctatgacgttggggcagacctttaatggcttcgccagcatcttgcaggatgagatcgctcacttgaatgaggccgccgccgatttcttggtggttaatatgggagctaccgctatcggtacgggtatttgtgccgagccgggatacgcggagaaatgtatcgcggctttacgtgagataaccggatgggatatccgtctctcctccgatttggtaggagctacctcggatacttcttgcttggtaggctatgcttccgccatgaagcgggtttgcgtgaagatgaataagatatgtaatgaccttcgcttgttggcaagcggccctcgttgcggtttgggtgagtttaacttgcctgctatgcagccgggttcttctatcatgccgggtaaggtgaatcctgtgatcccggaggtgatgaaccagatcgcttataaggtaatgggtaatgagctatgcgtgaccatggccggggaagccgcccagatggagctgaacgccatggagccggtgatggcacaatgctgcttcgagtccgtggatttgctgatcaatggtttcgataccttgcgtacccgttgcgtggacggtattgtcgctaacgaggatcgttgccgtgaggaggtacatcatagcatcggcgtggtgacggccttgaatccggtaatcggctataagaactcgaccaagatcgcgaaggaggcgttggagaccggtgttagcgtttatcaattggtactggatcatggtatcttgaccaaggaggaattggatacgatcttaagcccggagaatatgatcaagccggtgaagttggatatcaagcctcgccgttaatcgagtcctattatataatgtataccatttgtggaccgtataggtggatttttccatcctatgcggtctttttttagattataatctctatctttggactgacttaattctaataatcatgataaatagacgagattttttaaagaatgcgtcccttttcaccttgggtggcctgatggccggaaaggtcgggagcgcagatgcggctaaacctgtcacttctgaaacgatggccgctaagacagttggtttacaaatctattctttaggcaaggaactttatgcggatgtacccggtggattgaaaaagatcaagcaaatggggtacacgaatctggaattggccggttacaaggaaggcaagatcggcggtgtagacatgatggaattcaagaagatggtggatgatgccggattgaagatcaccagttcccacgtgaatcctccggtacgtgagtacacgaaggccaatcgctcccagatctccgagtattggaagaagacggctgatgaccatgccaaactaggcgtgaagtacttgatccagcccgggcaaccgagtacccgtagcaccgaggaaaccgctttcgtctgcgagatttttaacgaggcgggtaagatagtgaaagcggccggtattcctttcggctatcacaaccatgagatggagttcgccaaggtaaatccgggtagtacggaggccaagctgggaaggcgtgtgaaaggagattgcatctatgagttgttcttgaagaatactgatccttcgcttgtatttttcgagatggatgtttattgggccgtgatgggacaacaagatccgatagagtggttgaagaaatatccgaaccgtattaaggtattgcacatcaaggaccgtgctattctaggcgagtccgggatgatgaatttcgagaatatattccggcaagcttacgcgaatggaatcaaggattatttcgtggagttggagggtatgcctgacggacgttcccagtttgagggcgtgaaaggctgcgtggattatttattgaaagcaccgttcgtgaaataagtcttttgactcattaaaaaaacgctcatggcggtaggatgcttcctccgttatgagcgtgtttgttcgtaaagcagccataccaataaagggatatagtcctttaatttcgtccgtaatatcttgagcgcttgagagatgcggtatgcgattgttttgggggatacgcctgtccgctcggcgatctcgttgtaggtcatttcctcgaaacggttcatctcgaatgccttacggtattcatccgggagctcccggatggccttggaggccaaggccatcagttctcctatataaaaatcaggattctcgaattgctcttggaacttggcgtacaatctctcgtgcacttgttgcttaacctgtatgtggctgatcgtattgaggcatttattgcggacaatcgtgaagaggagtgatttcagggacatgtccgctactagggattttcggttttcccacagccacatcatcacgtcttgtacgatctcctccgattctggtactgttacatattgggaggcgaaggcgcacaatccccggtaatattgtttgtacacggtgtcgaacgcttgttcgtctcctgcgataagttctagtgaaattcgttctgtgttctcgtccacaatagtgtttaagtttgtttggttgcaaacttaatgaataattccggataagaggcatgaatcccgctactttttctttccttggttggctacggcttccatgagtttcttgatttcctccgggtcgccaaggaaataatcattcacgagtttcaagtcatcatcgaactcgaacacgtatggaacggctgtcgggagattcagatgaacgatctcttcatcggagatgttttttaagtatttgatgattccccgcaagctgtttccgtgagcggcgacaaggatctggtcggcggtccggagcgtcgggaagataacctctttccaataagggagaatccgctcaaccgtatctttcaaggattccgtacggggcaactctttatccggcacgtctttgtagcggatatcgaagcgagggttacgagggtcgttttccgataggggaagcggggctatatcgtaactgcgacgccagatcaagacctgctcgtctccatacttttgggcggtctcgctcttgttcaacccttgtagcgatccgtaatgtttctcgttcagcctccagctcttctccaccgggatccagtcttggtccatgcgatccaatacacaattcaaggttttgacggcccgttttaaataagaggtataggctttattgaacacatatcctttttctttcaataggttgccggccctataagcttcggccacgcctttttctgtcaaatccacatcggtccaaccggtgaaccggttctctttattccatacactttcgccgtggcgaagcaatacgatacttttcataggtctttttatttttatgatttgtttttctcgaaatcctcgatgacttcttttaatataggtagatgactatgttgtacatccttcgctgccgtgaggaaagtgacaaccggatgcttctcgatctctcgtaagaaaggaatgaaatccgggttctgcttgatctccatcccgtagcgaccttggaatacttcccaatgcctgtctttatcctcgtggaaccattggcgtaactccttagatggagtgatgtcttttctccattcgtcaaacttcgcatcctctttcttcagtcctctgggccatagcctgtcgagaagaatgcgataaccatccgcctcacttggctcctcataaatccgttttaaaagaatctttaccataagaagtctcattttgtggtaaaacagtagaaagagggatattgttgagcctttctttaggaacggtatttttgccattattcaattttcttgaaaaaaatcgtttttttgtttagtacatcttttgtctcaactgtattaattatagaaacaagaaaaaatggaaataaacgaagacatattgatccgatacatcgatgggatgttgaccgaggaggaagctgcggaggtgaaaaactggcgggccgcctctctagaaaacgagaaactgttggagcaggtctattttacgactcaagtggcaagtcgcctaaaagtcatgcggaccgtgaacccggacgaggcgttgtctcgttttaaatcaagaatccataagaaagagaaaagattagctttaagacaagtgttaggtgttattcaacgggctgcggccgtgttattcattccagtctttcttttatccgcttatttgttcatacagcagggtcaagggaacgtgcgtacgctagccgtacgcacgaatcctggggtggtttcggcgttcgatttacctgacggttctaaggtttggctgaatgccaatagcgaattgagatatccttcggacttcaatgcggatacccgtacggtggaattaaccggacaaggatatttcgaggtgacgaagaatgcccataagccttttattgtgaaagcggataaagattactcggtagaggtgttgggaacttctttcaatgtatccgcttacaaagacgagagtatgatagagaccaccttggtagagggatcggtaaagctgaacgtcgtgtccggaggaaagcgaatgacacagatgttgaagccaaacgagaaagccgagtatcaaaagggcgctggcaagatcaaggtgttcggcgtgaataccgaatatgacacggcttggaagaacggggagattatcttcaggaaccatccgatggataaagtattgaaaacgctggaacgtcattatcatgtagtattcgaggtaaaagataacgagatactcaagtccataataacagcccgtttcaaggacgagcaattgcctcaagtattggaatacctgaaattggcgtcgggaatccagtatgcgatacataaacctaccgttaaggacagtggatcgggaacctcagtcgtggaaatatcaaaatgagaaataatgtgtaaccttctaaaatacgtctgcccatgaagaaagaataaacaaggattaaaaacatacggaagaatattggcgtattctcccgtacgaaaagtcaagaagagctgttggcgcagctacaaataactttattataaatagtaacactacaaaaatatgaataaaattgtaaccttaaatgctttaagggggaatagttattctctttttcgaaaaattccgttaatgattaacatgggggtatgcgcattctgtttggtaccggccatggttttcgcagagaacacgcatgaagtcacagtcttaaacgctcaacaacagacacgaaaagcagtcggtgtcgttacggacaaaacgggcgaggctattattggtgctaacgtaattgttaaaggaactaccaacggtaccatcacggatatggatggccgtttcgagttggatgttcctaacaatgcgactttacaagtttcctatatcggttttaatacgcaagagatcgtctttaccggacaaccttctatcgaggttcaattggtcgatgatacgcaagccttggatgaagtcgtggtaaccgctttgggtatcaagcgagagaaaaaggctttgggatattctatgtctgaattgaaaggcgagtccctgacgcaaacccgtgatgctaacgtggccaacgctttggctggtaaggtagcaggtttgcagatcaagcaaaatggtaccggtgtcggtggttcctctcgtatcgtgattcgtggtaataactctattactggtaataaccagccgttgatcgttgtggacggtgtacctatcgataactttagcggtggtacggatgactattggggtaacggtaacgtggataaaggttccggtatctctgatatctccccggatgatatcgagagtatgtccgtattgaaaggcccggcagccgcggcgttgtatggtagccgtgcaggtaacggtgtcgtgatgatcacgactaagaaaggtagccagaataaaggttggggcgtaagtatcaactcgaatttcacggctgagaacccgatgcaaaccccgaagttccaagatgtatacggacaaggtatcgacggcgctttcgataataataaagcgacgagctggggtgccgctatggacggttcttctaaggatatggcgatgggttcttaccagtatgcggcgagagacaatgatttatataaggatttcttgcgcactggtaccacttggacaaacagcgtggatttgagcaagagttccgaggatatcactttccgtgccggcgtgacacgcttggataataagggtgttgttccgaatagcggaatggatcgtacgtctatcaacttgcgttctacggctaaactgtctaaatggttatcggccgacgtgaaggttaattatgtaagccagcatacgaacaaccgtgtgaaattagcgggcgacccggataatatcttccttaactatttaagtatgccccgaagtgtgggcttctctgactatgacgcctataaagataatgattggaaacgtgcggacggaaagcccgctggttatctgatcgacacgggagccaacgccaataacccgtattggtccgcttaccgcaatacgaacaaggataagaaagaccgctttatcggattcgcggccttggatttcacgtttacggattggttgagcttgaagcttcgctctggtatggataattacaccatccagtatgagacaatccgtgcgacaggtaacccgtattgggagaacaacggtagcatgacagccaatatggagaaattcaccgagatcaactccgatttcttattgacagctaaaggcaactgggatcgattcggtatcgtaggtacggtaggtggtaatatgatgtaccgtaattctacatggtacaaggaatcatccggtgagtttgtgattcccgatttccatgcgatcgccaacggtaagacacatggtggtgagtatactcgcaaccgtaaacaaatcaactcgctatatgctacggcatcattgtcttgggacgactatttgtatttggacttaactgctcgtaacgactggtcttcaacacttccaaaagacaatgactcttatttctacccgtcggtaggtgttagctggattttcacccaaatgttgaataagatggggcataacacgggtattctttctttcggtaagatccgtgcgtcttgggctcaggtaggtaatgatacggacgcttatatgttgcgtgactattataatatcagttatgatattaaagggggtatttttaatgccagcaacgaggattggatggcaaatccaaatttaaagaatgagacgatcaactcttgggagttaggccttgagttgaaggcgtttgagaatagggttggtgtcgacgtagcgtattataagaagaacgccaaagaccagatcttaaagatcgatgttccttccgctacagggttcaagaaaaagatgatcaacgccggtaatattgagaataagggtgtagaggttgcgtttaacgctactccttatatctccgagagtggtttccaatgggatactcagttgaactggtcaaagaatatcaacaaggtaatttcattgacagatgatacgaaagagcagatccttagtgacgcatcagtaagtttcttgaagatcgtcgctcacgagggtggagcctatggagatatttacggttacgcttatcaacgggatgataacggcaacattattatcggtgccgatggtgttcctttgagaacggacgatatggtattgttgggtaacaaccagccgaaatggatgatgggttggagcaataccttgtcatataagaatttcgtgttgaacttcatgttcgatatgcgttatggtggtgatgtgtatatgggatctatccgtgcgggtgcttcatccggtaatttagagatgacgttggatggtcgtgatggtatggttgttccgggggtattggccgatggtactcccaatacgaagagtattacggctcaagcttattggaatggtctttctagcaataacgtgacagaggcttatatgtacgatgcgacaaacatccgtttacgtgagttgagtttgggttataatttcccgagaacgatgttggcgaagactccatttacttccgctcgcttgagtttcgtggctcgtaacttgttcatgatttatagtaagacaaagggattcgacccggaggctgcttatacatctggtaacgcccaaggtatcgagtacggttctatgcctactatgagaagcttaggtttcaatattaatttggcattttaatgaaacataaatctaaaaatggaattattatgaaaagtaatataaagatattagcagcttgttcgtttatgatggcgagtatggccagttgcgacctgacaggtataaatgataacccggataagccgacggatgatgtaaattacaatatgagcgaacctcgattggcctctacgctacgtggtgggatgattatcgatggtgatgtggaacaacgcttgaaacctttgcaaattgatttctactctcaaatgttggtcgatggcggtggttgggcaactaagaattatatccaaaatgacgagtggaacaatttaacatggcaagcgtatctgacacagatttcttctatcaatatcgtgatccgtagtttgatggaaaaagataaggacttatacgctaatacgatcgctttcgctcgtatctggcgtgtgtatatccatagcctggctgcggataagtttggtccgatgcctttcccggcctatgctaccgtagaagataatcctccttataaatcggtgaaggatatctattatgaatatttcacggaattggatgaggcgttgaatagctttagcgatagcgctgagcctatattctcggatgcaggtatcgacttggtctataagaatgacgtttctctttggaaaaaatttggaaactccttgcgtcttcgtttcgctgttcgtctatctgaggtggatcgagagaaatgtgtcgctgaggcaaatgccgctttgacatctccttgtggtttgatctcaagcaaggctgataatgcttatatgcctccaaaagcggatggttcttggggacaggactataactatacgatgttccagattacttggagcggtccgatctgtatgtctaagtcatttgagaaattagtgactaatatcggtaatatcgattggcctgccggcgtggtaaaccagacatccggagttgccgtatcgaatgtacatcccgctaaggtagaccctcgtgccccgaagatgttccagccgggtattgagaatggtgattggaaaggtttggtatacggtgcgaaagcagaggaggcgaatactggtatttatcagtctaagcaatgtgcagagatgggctttattattaaagatggcgctccgtataaatctcgtccttatgatatgttcctttctgaggaagttgatttcttgaaagctgagttgttcgcccgtaatttggtcgccggtgatgctaaagctgcttatgaggcaggtgtacgtgcttccttcgagacttggggtgtatcgggtgatgttgaggagtatttggcttccacggaaaagaatgaggctggtaccagcgcgaaatatgacgatcaacaaggcgcaggcaatacggctttagagaagatcatcacgcagaaatatatcgccggacttccagatttggcgcaggaagcttggaatgacaagcgtcgtttgaacttgcctcgtttggatgtggctgtttatcgagatcaagctgtatataataatagtgatacaaatatcttgaatcctcaaaatttcatcaaacgtatgaaatacccgatgaaagagcaattggtaaatgctgctgaatatgagaaaggcaaatccatgttaggtgggaaaggtgatgtggtttcgaccccgatttggtgggataagaattccaactattgcacatcttcaaaataaataaacagacagattgattatattgagctttaacagaagctgatggttattctcgtttggagatacttatctgtgaagaacagtactccaagcgagatttttttgttataattgaatagtattagataataattcttacatttacccatgataaattgtgcgtgtgtaaattatgagattatatatttatatcttcattctactattattatgtatattcccgctgggcgcccaacaggaacgttcggaatcctatattcgtatctctcccccggttagcttggctggcgctctggatgagattgagagtcaaaccaattattcttttatttatgacgctcaggtgatcaatttatctgagaaagtgcgtaaatctttatccggacgtacggttttcgagattttaaatttattatttaagaacacggagatcgtctatacggtcatgaatgaccagatcatcttgaataagaaagaggcgataatccaaatgcaacaaaagctggatggtaaggtaaaaggcatcgtgaccgatcacaaaggagagcctattgcctgcgtgaatgtggtggaaaaaggaacgagaaacggtacgattacggatatggatggcagctttgtattggagcttcccgaggaggctactttggttttttcttatatcggttatcgttcacgggaaattgagtatgaggggcaattgtcattgaatgtgcagttggaggatgacgcccagattttggacgaggtagttattacggctcttggtatcgagaagaaagaatcttccttgccttatgccacccagttaatcacaggtggggaattggtaagggccaaggattttaattttatgagtacgctttccggaaagatggctggactccagattaaccggacttccgccggtctgggtagctcgtcccgggtgattattcgaggtagtcgttccgcatccggaaataaccagcctttgtatgtgatagacggtgtcccgatcttgagcattagcagtgagcaagccttgacaacgatcggtggtacggccgatgccggtaaccgggatgcgggcgatggtatctctaatctaaatcctgatgatatagagagtttgagtgtcttgaaaggggcttcggcctctgcgttgtatgggggacaagcggcgaacggtgtgatcttgatcaaaacgaaaaaaggtaaggccggggtacggaatattcatttctcctcgtcgctgactgttgatcaagcgatcagtctccccaagtttcagaatgagttcggacggatggaaggggcggaaacttgttggggagaccgggcttctcttccggtctatgaccctgtcggcgatttcttccggacgggtattaccgctattaactcattgatatttacggcagggaatagccatgtgcaaaattatttttcgtatgccaatacgaccgcacggggcatcgttcctaagaataatttaagcaagcataattttaatctccgtgaaagttcttctttctttgatgatcgtttgatcttggaggggcaggtaaacttgatactccaaacaatcaaaggaaaacctacggccgggggattttatatgaacccgttacaaggtttatacacgtttcctagagggatggatatggcaccttataaggagaactttgaggtatataacgagaaacggaatatgaacgtccagaactggtatactacgattactgattttgagcaaaatccttattggttggtcaaccgtacggaaaacgaggacaaacgtgcccgtgtgttggcgttggcttccgctagtttcaaggtgacagattggcttacattacagggccgtggaaatatcgattatgtgaatgataagtatcagcaggaaatatacgcttctacctctccgggtatcgccggtgagaacgggcgttacatttattacacctaccagactacgttgctctatggggatttgatggccaaattgaataaaagctggggtgatttctccttgaacgccgctatcggtacgagcataacggacacacgcaccagtgcgttgaggctggattcgaaaacggcttccttgtattatccgaatgtctttacgatcgctaatattaacatgtcgtccagtgcctacatcgaggagtcggatgacgcacgccggcaaatgcaatccttttttgctatggcgcagttgggatataaggaaagcctttacttagatgtgaccgcacgtaatgactggtcatctacccttgcgtttacggaacgtaaatcaagaggttttttctatccttcagtcggtctttcttggattatccctaaatccttttcgatgccttccttgatatcttttgggaaagtacgggcttcttggagtaaggtgggtaatgatatacccttattcgttagcaatacggtaggccatatcgccgcgggcgggattccccagccgaatgatacggctccgttcggtaccttgaagccggagatgagcagttcttttgaaataggtaccgaatggaaattctttgattatcgtatggacgtggatcttacgttctataagaccaatacgaaaaatcaactcttctctttaccttcttccgctggagccgcatacaagtattattttgtgaatgcgggaaatatacagaatatgggagtggaattgacgttcggtgcggttcctatcttaacgaatcagtttaaatggaatacgacactcaacttttcccggaataaaaatgaagtaaagaaactacatgatgatttggctagctttattcaaggagatgaaggattctcctctagctatacgatgcgtttggtggaaggtggctcgtttggtgatatctatgggaaagcttttgagcgggataaatatggtgcgatcgtgtatggtcgggacggcttgccccaagagatcggcagcgggaatacggctaaggtggggaattgcaatccggcgttcttattgggttggggaaatagtttcacgtataaggatttctcgttctatttcttgattgacgggcattttgggggagatgtgctggcccagactcaggctgtgcttgaccaaacgggagtgagtaaggtttccggagaggcccgtacgatggggtatgtggatttggaagggcatcatatttataacataaaaggattttatgagcaggtgggaggacgaaacggtgtgactgaatattatatgtacgatgctaccaatatccgtttgcgggagttatctttgggatatacgctaccgaagagattgctggggagaaaacaatttctcaaaaaggcggaactgtcttttgtcgcccggaatctattctttatttataaaaaggctccatttgatccggatgccgtgctttcggcgagcaatagcaatcaagggattgatatattcgggataccgactacgagaagtgtcggctttaatgtgaaactttcattctaagcgtatgaagacgagatttctgaataagatggcagctctgttggctgtattactccttttttcctgtacgggtaaattcgaggagtataataccgataatacgggttttaccgatgagcagaaaacgtatgattataatacgttcggtgtctggctaaaggtagtccagatggggatttattttaattatgattgggggagtggcaagaactggcatttccagacgatgcaaaatctgaatgcggatatgttttccggttatatgcatgattttaaacccttcaacgcaggattggggaatacggtctataatttgcaggatggctggaatggtacgatgtgggataatacgtatggatatatcatgacggagataaagcagacggaagatcattcccgtgataaatatccggctttctatgcgatcgctaaaatactgaaagtagagatcatgcatcggatctcggattattatggcccgattgtgtatacaaagtttggggagtcggatgccggggtaatgccggattcccagaaagacgcttattatgcttttttccaagatttgggggaggctattcacctgctgtctgaatatgatggagaagaaaccttttctcgtttcgatatgattatgccggagaattacaggacgtttggggaatggatgcgtttcgccaactcattacgtttgcgcttggcgattcgtatcgctatggccgaccctgataaggcaagggatgaggcgcataagtcgctgacacatccagccggtttgctggaggaggcttatgaggtcgttgcggtttctaccgccggaaccggctactcgaatccgctgggggagatcaataaggcgtggggagaggtttttatgaacgctaatatggaatcgatccttaaaggatataaagaccctcgattatcccgttattttgagcctgctaccggacagggatattccggggagtaccgtggaatccggcaagggacaggatttaatcattcccgctatagtgagcattcgagaagcacgattacccagaaaacggacgctatcttaatgacgcctgcggaagtttggttcttacgtgcggaggcagccttgcggggctggtccggggaggacgccgggacttgctatgagcaaggcgtacgatcatcgttcaatcaatggagggtaggagaggcgaacgcttatttacaaagtgatcatgtagccgccgatttcgtggatacgtttactcccgactattctgcgaaggcgctttgcttggtgtctccggcatgggatgaagaagcctctagggagaccaagctggagaagatcattacccaaaaatggatcgcttgttaccccgagggctgtgaggcttgggcggagcagaggcgtaccggttatccccgtttgttcccggttttggtgaataaaagcaatggaaagatcgatatgcgaacgatgattcgtcgtttgaatttcccggttagcattatttccggtaacccggctcaatattccgccttgtgtgagtatttgggaggtccggataccggaggtactcgcttatggtgggataccggagtgaattttcgtgattagcaactaatttttcctcttcctgccgatagaataccgagattcttgaaaaaacactacctttggcaccgaaaattataaaaaaagggtttatgtctttaaaacgttttggtgtctctttggaagacaatctgttggaatcattggatcaatatgtgaatgagaatggcttcgccaatcgttcacaggcgattcgttttctgatagagaagaatgtagccgaacgtaaatggcaatgcaaccatatcgtagccgggacgatcgtgatcatgtatgaccaagtcaagaaagagatctccttgaaaatcacgagtatccaacaaaattataaggatgtgatcttgtcgtcttcccagtattatatcaatcagaatttttgcttgcatatagtgacggtgatgggaacggcccaccgcttgacggaattgtcggataagttgacgacaatcaaaggcattaagcatggtaagttggtgatgagccgggcggattaatgcttttttttgcgggtttggtaacacgttttttagtagacgtgctactaagggatgtttaaaatgataaatattatagatgtagtagtatatgagaaaagaacttttactggttttcggactgttgataggctccatggcatttgcgatagatccggcagagattgacagtctgatcaatttgaaaggggtggtggtttccgccaacaagatccatgtgaaccggaacagtgtgccgttatctatctcggtcatcgaacgggaggagattgaggctagcagtgaatcggcgttgcttcctgtattatcggagtatgtgccgggattatttgtgacacaaaaaggaatcacaggatttggtgtttcggaaggagcggctggaaccgtaaatattcgtggcgtagggagtggaaataaggttttgatgttgtttgatggacaaccgcaatgggcaggtgtgttcggacatgcattacctgatacatatgttgcttcggatgttgagcgggtagaagttatccgtggaccgggttctttattatatggctcaaacgctatgggaggagttgttaatattatcactcgtcatcataaacaagaaggaaggcgtacgcaggcccgtgtgatgtatggttcctataacacacaaaaatatatggtgaataatggttttaacgttgggaagttcagtagttttgtctcaattaaccatgatcgtactgacggacatcgtccgaattcggattttaatattactaatggttttgctaatttgggatatacattcaatgaacattataagataacaggagatgttagcttagctaaatctaaatttcaaaatccagggaagacctcggctcctgtattagataataagatggatatcctgcgtggtacggcatctatggctttggtaaataattatgggaaaatgagcggggctttacgtttgttttataattggggaaatcataagattaatgatggctacgatccgggagagaaaccattgacttatttattccgatctgatgaccacaacgtcggtgtcttattatatgagtcttttcgtttgtttaaagggaataactttaccgtaggtattgattataaaaactggggtggacatgcttggaatgataataacgatggctctgaaaaagaattggttgacaaaactgtgaatgaaacggctggatatgtcattatgcaacaggatttgtttgatatgttaagtttgaatgccggcgttcgttatgagcacagcagtacttatggtggagaatgggtccctcaagggggagtgactgttcgtccttttgagggaaatatgattcgggcttctgtttctaaaggttttcgtagccccaatattcgtgaaatgtatatgtggggagctgcaaatccagatttgaaaccggagagtatgttgaattatgaggtggctgtcggacaatcttttttgggtggtgatttatatgctgagttaaccgcattttttattgatgggaaagatatgatttattcggtgagcgtaaatggggataataggcctcctttcaagaatctaaatacgggtacctttacaaataaaggtattgagtttgaaactcgttatcaaatttgtgagaatttaagtatgaacttaaattacagttatctgcatatgagtaagcctattcctggtgcccccggtcaaaaattttatgtaggggctgtttataaaccgggacgttttactttaaatgtaaatgtacaatctatctttgatctatataccaatgaaggttgtacagagaaggaagattttacaaccttgaatgcgaaggcagcctaccgtttcggtacacgtgataaaggcttgaatctatttgtcaaaggagagaatttaacggctacccgttattccatcaacgaaggattcccgatgccgaaggcgatatttatgggaggtatagacgtaactttctagcatgggtggaaaaagaacttccccgaatactcatatctccttgaattttatgtctactttctaatatttgttttatctttgcttcatcagagtttatttgattttgattaaaagaataaaacgttatatatatggatgtgaaaaatgatttgagtggaggaaagcccacgttgctaatcgcggaggatgaggaaagtaattatttacttctgaagaccattttacataaatattgtaatttgatccgtgctaaaactggtttggaagctttggctctctttaaggaaaacgaggtggacttgatcttgatggatataaagatgcctgagatgacgggtatcgagtctttgaaagaaatccgtaagctatcgaaagatatccccgtaatcatgcagtcggcttatgtattcgactctgatatggaagccgctaaagaagccggggcttccggttttatcacgaagccgatcaatctaaaggtattgaaaaatacgatatcgcagtattgtccgtcgatcgtatggtaaggatttattaagatgttttagatttgtataaacggcattttgccgtattttttgttatttttgtagaaaatcgtcaagagggcgctttacaaatgtattctaatctacaaaaatgacatgcttatgataaaaaaagaacatcttgtatccgacatttctaaactaaaaaaagtatataatcagagcttcccttggttggtgaccttagcggaagaaagtgagaacgcaaagtattttaaggatgctttgcgttctcttattttatcccggctcacggaaaaggaaagtacccaagaaaacgtaggaatggcggtggcgagacgtatccttcttttgattgagcatgatgatactttcgtggacgagctgtctacgggcgagcgtcttccggtgcggacggtcacttatctttggcagttcctgatcggccatttggaaaatgaggtctctcctgatttattcattgacctataccatcagtttgatttattggaatatccggttgagatcctaccggaccgggcattggtgaaaaggcagatgagccgttggccgaccgggcttgacccggaggtaatcgctatccgtgagaggaacaaggagcgtatcatctcttgcttgatcaagaagatagaaagacgccatagcccttcgtcacgttttcagttcgccgagggcatctcctatgaggagaaagaggcccgggtacgtgaatggtggaataccgctcgtttccatttgtcgatggcgatcaagagtcctacggaattgaacttctttttgggatattccctgtcggacgagacgatgagcttattggcccgtgccaaaaagaaggggatgcccttttttgtgactccttattatctttccctattaaatatagaacatgaggggtatgacgacgctacggtgcgatcgtacatcatgtactcgaacgagctggtagatacgtatggaagcattaaggcgtgggaaaaggaagacatggtcgttgccgatgagccgaatgcggcgggttggctattgccggagggacataatatacaccggaggtatccggaggtggcgatcttgatccccgattcgatggggcgtgcctgcggtggattgtgcgcttcttgccagcgcatgtatgatttccagagcgagcggttgaatttcgatttcgaggccctgaagcctaaggagagttgggaccggaagttacgtcgtctgatgcgttatttcgaggaagacgcccagctacgggatatcctgataacgggcggggatgccttgatgagccagaacgctaccttgcgtaagatattggaggcggtatataagatggcggtgcggaaacggaaggcgaacgagagccgtccggagggcgagaagtacgccgagctgcaacgggtacggctaggttcccggttgctggcttatcttccgctgcgtgtgaccgatgagttggtcggtatattgagggagttcaaggagaaggcttccgctatcggcgtgagccagttctatatacaaacgcatttccagtctccactagaggtgacaccggaggcgaggcacgctatcgaggcgatcttggcggcgggctggacgatcacgaatcagttggtatatacggtttcggcttcccgtaagggacatacggcgaaattacggcagaccttaaacgcccttggggtggtttgctattatacgttctccgtgaaaggattcctggagaattatgcggtttacaccccgaatagccgctcgttgcaagaggctcgtgaggagaagatcttcgggcaggtgccggaggagaaacaggcggagttgtatgatatgatccgtaaccaacgtcctttaggcaagcgtttggttcgtttcctgaaggaaaacgggttgttgttcgcaggtacggatcgtaatgtattgaacttgcccgctattggtaagagcatgactttccatacggtaggcttaacttccgaaggaaaacgaatcctcaagttcgatcatgacgggagccgtcggcatagcccgattatcgatcaaatgggtgaggtttatatcgtggagaataaatccgtggccgcttaccttaggcaattgaaggagatgggcgaggatgtcaatgagtaccgtacgatctggaattattgcgagggagagacggagcctcgcttcagtatttatgaatacccggcttatccctttaaggccacggaccgaatgactaatcttgaattatgaattctatcctcatatgtttgccttggtttcgtatattttgcttaattttgtttcactgaatttagaaggatatgatacagaacgaaagagaaatcaggcatgagcttgtgttacaggccgcacgccgtatgatgacagccgctcgcacggctcctaaaggcaagggtattgatatcatagagatagcgatggtgacggatggggatatcttgcgcttgtccgatgagatgatccagatagcggccgagaccggattcaagttcctgctccgtgacgccgagaatataaagagtgccgacgccgtggtgattatcggtacctcccagaaagtacaaggcttgaactgcgcccattgcggtttcgatacctgcgtggaaaagccggacttggttccgtgcgctattaattccgtcgatctgggtatcgctatcggctcggcttgcgctacggcggcggacctgcgtgtggatactcgtgtcatgttcagcgccggcttggcggcccaacgactggggctgttgggagactgtaaatgcgtgatggcgataccggtcagcgcctcgtcgaagaacccgttttttgatcgtaaaccgaaagaagaaccgaaaaactagaaacaaatgagtgactctattctaaaattcgcgaataagctggagatacgttattcctttaataataaatccaattatatggatgccatgaccaagcaccggtgtgagaaggagattcttacgctgatacgttccttggcggatatgctggacgtgaagctgacggtttacaacgagccttacgataaggagggtggtttccgtgagaagctgggcgtggctggggagagtagccgctctatctctatcgtgttgaacttggtgatgcagatattgacccgtccttccttatcggtaggtggacaaccgctgatggatcgtacgccggcggacgaggaggagatgcagcgtgagctgtccaagttacgccgtgaactacggctgaagactccgggggctacgccttcacaccgcttgatcgacctgttgaacgcctcgccccgtttctgtaagtgtaagtctaatttctacgaggctttgaaagggtatccgaaggtgacgaaaatctcggtacgtgagttgaacgagaaggatcgcaaccgttccggttcgctggaggtgaaacgggatcagttcgattattttatcttgcgtagcgacgatctgcctacggtcaaggataataaggccacgatagagatcatctcgccggtactgaaagacagtaagtatcggtggaaaggtatctacaacaagggaggcgagacgatcgatttctatatgcaagatgaggatttcaagaaacagatgttcgaggacaagatctcgttcacgagcggtatgtgcatcgattgcgtcttggagatcgcccgccgtctgtcggagctaggagaggtggtcaacgtgagctataccgtgactacggtgatacgtacccgtttcgataagatggagatcgtcacccctcaaggcaagcggcatcttcgtaaactggaagccgcgaagaaacagcttacgctggatttgttcggctaatccgacagcggtattcccatcgctcccaaacactatcgtgttccctcctgaacacagtagtattcatcagcgaacacaatagtattcaatcccggacacaatagtctttttgctttgaatactattgtgttttttcgtaaggacgggcagcctatacgtgtgtatatttcctcgggtaattgaataagatcgccaataaggcgcctgctcccaatagatacgggtagtaaagatattgcatgatctcgataggggagacatgcccgagtccggcggccatcaacatctgggcgccgtaggggatgattccctgtacgaagcaagagaagatatccaataggctggcgctgcggcggggatcaatcttgaaccggtccgctatatccttggcgatcgggccggccatgatgagggcgatcgtattgttggccgtgcagaggttggcgaaacttaccaaggccgctatgctcatctcggcccccttggaggaatggatgcgggaggtaagcttgcggatgatccagtcgatacccccgttatagcggatcatctccaacatgcctcctgccaggagcgtcacgataatcagctcgcccatattcgtgatacctaatcccatggaggcgttccagccccagatatcgaagctgccggtccacagacctacgataccggacaggacgatcccgatgaatagcaccagcatgacattgatcccgcaaacggcggttaccaataccaccagataagggatcaccttgacccattcgatcgggacgggggcgtaagcgttctccacgccgcttcccaccagcacgtatatcaatccggtcaggatcgctatcgggagggcgatacggatattcaccttgaacttatcggacatctggcaaccctgcgtgcgggtagctacgatagtcgtatcggatatgaacgacaggttatcgccgaacatggcgccgctcaccacgacacccagcataagggcgtccggcatccccgtcttgtccgctataccgacagctaccggggccaaggccacgatcgtgcccaccgacgtacctaccgagatggatatgaagcaagcggctaggaagattccggccgccaacaggttaccgggcaggatggacatcgccagattcacggtagcgtctacggcacccatcgctttggcggtctgcgcgaaggccccggcgaggatgaagatcaataccatcagcatgatattgctgttggccgccccccggcagaactgctcgatacggttgcttaatttgcctcccttggagatcgctatcgctacgatcgaggagatgacgaaggctaccgttatcggcatcttatagaaatctcccgccacgatagataccaccaaataagtcaataagaataccaccagcggcgtcaatgcccatgcgttcggtctgcgttccaactctcccattttcttatctctcctacatttaactgtcaactgtcaattctcaactgtcaactcttagaaggagaaccgcagcgctatacgcacgccccccttcttgatattcggttggtccagatacgtcaaccggcggtaataatcgatccgtaatatcttgaagatgttctccagacctacgctggcctccaggtaaggcgtacggcccatcggcgaggttccctcggggaagcggtatagtcccgtcgggtccaaggcagggttgttcttatcagtcagtcctccgtagaaaccgctgaacgatatcacctcacgcaaacgtagccacttcacgccgggaatacggtttaagatccatcccttcatataatacgtgaagtagaacgaaacatactggtcgcttacaaactccagcgcacgcatcatgttgaaggcttgcggctggatcgtgatggactggttggtattcggcatgatgagtaaggggaaaggaaccttgtcccataccttgcccgccgtcaccaaggcgtcgatatgtccgaaggaagagagccagatccgtttctcggcgctgatctccgtatggttgtagttgaagtcgccccccaacacgttcttcaatcccatctgatgggatagcttgaatacgggagcgtctttcgagaggttgaaaagcgagttcttaccctctcgtccgttataggcacgctcgcccggggcgaaacgaagctgggcccctagctccgtgttggtgaaactctttaggttcgtcaatgtcccgtcggcgttgtaacggtcgtagcggagcgttccggccgcctcgttgttctcgttccgcgcccaagtggtaagggtcaggccattcagccattccttctggtactggagcatggtcttgcggatgtattgcatcatggtgacgggctcgcccaccttccatgccacgaacatattatccttgctggtgaagaggaagtcctgaccgggcgtatatacgtcgtactcttggatcgcggagatgttgttcaccgggctttctccctcgtgatatttcttcttgttcacgctatacgtcagcttggcgttatactttagcttacggtcgtttacgccataggccagataaccgctaccgaaccagtgcgggttgaggtttgccgtcgtcatacctcccacacgcatgcggaagccctccagatggttggcgctgaaagtggtattcatcggtccgaaatcgaacttgctcttatccttgtccgccgtggtcgggatataaccggtgatcaatatctcggcggtcttgatgatcacgttgaaagccggtaccttgcgaagttgcgccagcaagtcgtccaaggcgctctctttctctttcaaggggacatggcggttgtgtatccagaaggtgtcggtctgggcggtggcttcgggcaactcatggatcggaccgagaaggccgaagatcgagtcggcgttctgcacgtcgaactgatacttatcgaaattccttagctggtgggcatagagctgttgcgccccttttacgatatagaaattaacgtaggtattctcgttggcgagcacccaagtgctatccggcatccgcttgaactcttgctcgatccggagcttgtccacccagttgaggttgatgttcgccggggtgttcaagaggaatttcttgacggcgtaattaccgtccagcgtgatgtacaagcggcccgtgaagccgtaactctggctgtttacgggcacgaaggcgagatccacacatttatctccggcaacgtccaccgtatccatgatataatatttgtaataggagacggccagcgtggaagacagcgggctcacgaaacggttcaacaagatattgatattgttgtcgaagatattgacgcccttgaatatctcctcaaggttggcggtgatggcgcctccatcgtccaaggtcttgtcgataccctgctggcgcttggccttggtgatcgtcttctccgccttgggatgtttgcggtagtattggtcggagatcgtctcacggacggagatcgtcaggatcggtttcccgttgaactccgaggtatccagatagttcttgatgaacttgaatttcttcaggaacttattcttctcgagattggggttgaagtcgtccagcgacatgctgagcttctcgtacacctcgctttggtactcgtccttcgcctcgatgcggttgtcgttcttatgctctatgactttcttgatcagttccacggcggggttgtccttgcgggaatatttctcacgtttaggcttgacgactacctcggcaatctcgaacgaggtaggccggaggagcacgttgagggcgttgttcttttgccccgcctttaggtttacgaccttattgtcatatccaagcgaggatacgaccagccgggtaagccctttgtcattctggaggctgaaagccccgtcatcgtcggtcatcgccccgatcgtcgagttctcgaacatgacggatacgtaggataggggttccccgcttacggagtctctcacgattccggacgcggaagttatgctctgggcgtataggacggaaatgccggtcacgaattgtaacaggactagcaaagtgatatagcgaatagatcttatcatgtaaatgtctcgttattccttcacggataatactgttggcaaaggtatgtttttttcgtgggagggaggggggagaggctattaataatcattaatcaccgggtttcccaccgctcgatgggaaacccggcggtagaaaacgcgagcttcattatttaacgaaaaagatcttcattattttatatctctgatggcgagtcgctgtcggtagcgggcttgtcgccttcttgtttcttggcggctgcggccctcgcttgcgctatgcgttggttgtagagggcgttcgtctcgtcgaccagcgcgttgaggcggttgatgaaggcggcggtctcttgagtgggcttcaccacgctttgcgcgaaggcgtaggtggtcatctcgtcgtattcctcgtccatgcggaggcggattttcttggcgctctctacggggtcgtccgccttggcgttggcgcgttgctcggtgagcgtggcgtattgcttgttcttctctttcagcgctgctactacctcggtgaggttgatcgccgccagcgcctcgggcatcccagccttgtcgaggtctaccagcaagccctcgatggcggccgtctcctgcaagttggcgaggcgcgcggctccgatgtagggtttcacgggaaggtatagcttctcggccgccgtgcgttgcgccgccagcgggcttttcgtcatttgggtaatagtggaagtaatgaagatcaagagatcatccctctccttgtcgagggcggacatctgcgcggtctcctcgctggccgaggattggttcacggcgtcggtcaacagggcgaaatcggtggcgaaggccgtacgaagttcttgggggatgcccagcgggtcgttcgggtcgaagctgatctcgtcgggagattccgagtcgcctccgccacccgcgagcaggttcccgtagcgggccatgaaggttcggtactcggcgttgttcaatctctgtaaataaataatattcaccttggttattttttccatatctgaaaattttaggaggatcgctagatccgttttacagtgctaaaggtatgataattttgggatccagccaccaaaacctatcgcatttttcatatattcgggcttacatcgggcatgaaatggaatttcaattttgaaatggggcctacattgggtgcgaaacggaatttcaattttgaaactgggcttgcattggacgcgaggtggaatttcaaatttgaaatggggcttacattgggtgtgaaacggaatttcaagtttgagactgggcttacatcgggtgcgaggtggaatttcaaatttgaaatgggacttatatcgggcgcgaggtcaaatctgtaaaaaatgcgaggcccaaccttggtggccgggcctcgccgataaatcatttcttcttgatcacgatgatacgtgtgccgccctcgggctgtaccagatccccgatctgcttgccattgtcatctaacgtaggaaccaagaacggataatattcagggttgtaatactgcttcgtgcttagggagccttctcgggggtgcatggagtaggcgagcacgccgcatctctacaacgcctccttgttccacttgttcagcgggttcttcccctcgggggtatagagctgggcgatacgggcggcgtaggctttctctaccttgccccggacgatcttcatggtgctatttaccatgccgttttgctcggtgaaaggctcggggaggatggcgaaggtggtcggcaaccaacgatccgggaatagggtggacaggtcgcctcccttgcggaaacggtcgatctggcgctggatgatacggatggcctcttcccggccttgatcgctcgtgaggtccagattctggtgggccagatgtttccgcaaccgttctttgttagggaccaacagggcggtcgtgtacggactctggttattgtacaggatcagctggtcgatgcaagaggaatgctctaccaaggcttcctctataccctccggactgtatttctccccgtcgcttccgatcagcaggctcttgaaacgccccaacacataaagaagcccgtcacgcatatatcccatatccccggtgtacagccaaccttcctttacggtatcggccgtcgataccgggttcttccagtagccggccatcacgttctctccccggatgacgatctcgcctttctcccccggaggaagtacgttgccgtccatgtcgcagatctttaggtcgaggggccgcaccaatacgccgctactgccgaaggtatggcggcgggggccgttggtcgagatgatcggtgtcgcctcgctcagcccgtatccttggtacatcgggattcccaaggcgtaatagaacttctgcaagtccttatccagcaaggcgccccctccgataaagaacttcagctcgcccccgaagttctcacggactttcgcgaacaatagcttgtcgaacaaacggaccagtggcttcaagaggacgcggaaaccttttccttcctcctcgtcgctatccccgttatagatataaccgatccgtaaggctaggttgaaaaggcggacggcgttcttgcctcgcgctcggataccttgctcgatattcttcttgaagttcttcgccaaggcggggacgctcagtatcaggtacggcttgaactcctttatattgatagggatattcttcaaggtctccataccggtacgccctacctgcacggtagctaccgaggctcccttcgacatgaagatgtagaatcctaccacgtgggcgaagcaatggtccagcgggagtatcaccaacgtacgccacgtatcgtctatatccacgcaagtgagcgcttgctccacgttcgccgtatagttacggtgggtgaggatcacgcctttcggatcggcggtcgtgccggaggtataggtgatggtggcgtaatcatcgttgcccagcgattgcccgatcgccaagaactcctctagcagatgaatacccagatagaccttccccatccggcgtatctcggacagcgacatctcacggtcttggtattccgcttgctcgtcgagtacgatgatcttccgtacggcggggagcttatccttgatcgcccggattttcttgagttgctggcccgataccatgatatatttcacgtcggcgtggacgaggcggaacaggaggtcgttcgcctcctccagcttgatggataggggcacgttcgtcgccccggcgtagaacatggccagctcgccgatgatccacgcgttgcgcccttcgctcagtaaagccatattatccccctttcgcacacccagcgatatgaggcctgcgccttcctcatagacgaggtctcgaacctcggagtaagtggttggctcgaatcgcttgcccgtcttctcccataaaaaaggattactcgggaatcgcttggctgaactctcaaaaaggtctataatcgttttcttttccatatcttttcgtgtttgtaagaggatgtgtcaaaagttggttgagtttattttttccatctcttgcaggtagccgcatgccgcttccaccgtagggacgttcttgatcacgatacttcgcttgccattctgctcccggaggttgcattcacggggatgcttttggatgaagcccagcagcttgccgaacgcctcgctttggtaatacgggctgtccgggttattcaccaagaagaggctcatctgccctttcttcaggatcaccttctccatacccagtttcttggccatgcgacggaggcgcacgatccggatcaactccttgccctccttcggtatcttgccgaagcggtctttcaggcgctccgtaaaggcgaggatgtcacgttcctcctccatattatccaactcccggtatagggaaatacgttccgagtcgttggggatgtaggtgggagggaacatcaattccagatcgctctcgatataggtctcccggacgtactcgctacccgtatcccgatgcccttcggtgttatcggcgtaaagatcggcgaattcctcgcttttcaactcgtctaccgcctcctccaagatcttctggtacgtctcgtaacccagatccgctatgaaaccgctttgctcggcccccaacatattgccggccccccggatatcgaggtcttgcatggcgatatggataccgctacccagctcggagaagttctcgatcgcttgcaacctgcgccgtgcctcctgcgtcagcgaggtgaggggcggggaaaggaggtagcagaaggctttccggttgcttcgtcctacccgtccgcgtagctgatggaggtcgctaagcccgaattgctgggcgttgttgatgatgatcgtattggcgttaggcacgtcgatgccgctctccacgatactggtggctatcaatacgtcatactcataattcacgaaatcgaggatgatcttctccagcttctccggctccatctgcccgtgccccacggctacccgtgcgtcggggacttcccgccgtaccaaggcttccatctcgtaaatgttctggatacggttgttgatgaagaacacctgcccgttccggctcatctcgaaattgatcgcttcccggatgatatcgggattgaaacgctccacctccgtctgcacgggataacggttgggcggtggcgtggtgatgctggaaagatcccgggcccccatcaaggagaactgtagggtacgggggatcggggtggccgtcattgtcaaggtgtccacgttcaccttcagctgccgaagcttctccttgacggataccccgaacttctgctcctcgtcgatgataagcaagcccagatccttgaaacgtacatccttgccgacgatccggtgggtgccgatcaagatattcacctcgccctctttcagctctttcaaggtagccttgatttgcgcggccgtacgggcccggctgatataatcgatcttgcaagggaaatccttcaagcgctcacaaaacgtctggtaatgctggaaagccagtacggtggtgggtaccaacacggccacctgcttattgtccgataccgccttgaatgccgcgcggatagccacctcggtctttccgaaaccaacgtctccacaaatcaaccgatccatcggacgggtactttccatatccgccttgacctcggcggtagccttcatctggtccggcgtgtcctcatagatgaagctggcttccagctcatgctgcatgaagctgtccggcgtgtaggcgaaacccgtctcttgcttgcgtttggaatagaggaggatcaagtcccgggcgatatccttcaccttcgccttggtacgttccttcatcttttcccaagcgcctgtgccgagcttactcaacttaggcggctcgccgctctctttccccttgtatttcgataatttatgcagggaatggatgctgacgaatataatatcgttattctgataaatcaatttgatggcctcttgcatcttaccgttcacctcggtgcgtaccaagcctccgaactgtcctacgccatggtcgatatgtacgatataatccccttgcgagaactggttcagctccttgagcgaaagggtaatctttccgcttcgtgccttatcgctcttcaagttgaacttgtggaagcggtcgaacaattgatggtcggtgaaaaagcagatgcgtagcgtatcgtcggcgaatccctcgtgtatcgtgcggtttacggcggtgaaagggatattgtcgcccctatcctcgaaaatcatccggatacggttggcttgtttctcttgatcgctcaatatatataatgtatagccctcgtcgaggtatttatggaacgactcgctcacccggtcgaaattcttatgatagatcggctgcgtttgcgtagagaaatggatggtagcgtccgccgttcccatcggccgtgccccgaaatgaatgcgacggaaatccaagacctcccgtaggaagtcctcgccccggactaatttcttccgcatctggtcgatatcggcgaaggattcctcgtcggctaccaccggatcgtcgttccatacgcttccgatgcgctccttgcaccatgcgagatctctcgccgctatgcaggtgttccggggaagggagcctagcaaggaagtactatccttggcgttcttgctcatctccggtacgatatagatgctgtccagtttctccttgctgagttgcgtctccacgtcgaacgtacggatggtctccacctcgtcgccgaaaaagtcgatacggtagggaaactcgttggagaaagagaaaacgtcgaggatactgccacggagggcgtactgccccggctcatatacataatcgacctgctcgaagccatactcgtccagcacgtcggagacaaacatattatccagcttctcgcccacgctgatctttaaggtattctccttcaatacctcccgggccacgactcgttccgccaaggcgtccggatacgtgacgatcacgaaagaggcgtccgggtcttgcaaccggctgagtacctcggtgcgcaggatctcgttcgccggatcgacatgcccgtacttgatggccctccggtaagcggatgggaagaagtatacctcattgctggcggtaagttgcatcaagtcgtgatagaaatagccggcttcctcttggtcgttcaacacgcacacataacttccccttcctttcgtaaaaagagaggcgatcgtcattgccggacccgagccattcagtccctttaggaatatattgcgggacgtatcgtttttcagtaaggtgtccagcgccgtcacttgcgggtgagcggcatatagtttcaataattcttgtacttccaaagcgaaatcttgtttccgcaaaggtaacctttttgcttaagtttttataggtgttcgtccggtttctttctttatcaagtaacttttacggctctctaaaaccacagcgataattcgagtaggggattttgggggaaatgcttttgggccccctgaaaaagggagacttatcgtatatttttctgtatgttctagttccttgccgtatgattctgtaaaaagtcgtacgtgtttcccgaaaaacatgtacgacttttcaaaaaaacacgtacgtgtttttcgaaaatgataatcgtctttttaaaatgttagtatccaattatttatgtattcatgtcatttgcatacttattgtatggaatagtttaataaatttcctctatcttgatataaaaattatctgtttgacagctacttatacttgccgtatctttgtggtacaagaaaagcaaaaagtataacaaattaaaaagtagcaattatgagaacattagattatatccacttagacgcatcagcggtaagtaacgtagtagcaagcttgaaacaattattggcggactaccaagtattctatacgaaccttcgtggtttccactggaatatcaagggacacggtttcttcgttcttcatggtaaattcgaggatatgtacaacaacgaccattttgtacgtgcctatcacgatacttacggcatgccgaccatcgtgacaaattgctcaaacaactatggtccctatcaattcccggaaaaactgatacccctattcatcaacaacatccgtcaccgcaagccgctaccggtctatggcaagggcgagaacgtgcgcgactggctgttcgtggaggatcatgcccgtgcgatagacttgattttccacaacggaaagatcgccgagacctacaatatcggtggcttcaacgagtggaagaatatcgatatcatcaaggtggtgatcaatacggtggatcgtttgttaggacgtaaagagggtgaggatatggatcttatcacctacgtgactgaccgtttaggccatgacgtacgctatgccatcgactcaacaaagttgcaaaaggaactcggctgggagcctagcttgcaattcgaggagggtatcgagaggactgtgagatggtacttggagaagcatgaatggtgtgaaaatattattaatggtgaataccaagattactatgtagaaatgtatggaaatcgttgaaaaataattataaaatgagctatatagtcaacaaacaatacaaaatagccgtagccggtaccggttacgttggtttatcaattgccactttgttatcacagcatcatgaggtggtagccatagacatagttcctgagaaggtagatttgatcaataataaaaaatcacccattcaagatgattacatagaagagtatttggctagtcataaattgaatttgaaagctacgctagatgtggagatggcttataaggacgctgattttgtggtgatagcggctccgacaaattatgatagccagcgaaatttctttgatacgtccgctgttgaggctgtgatagagcaggtgcttcgttttaatccaaatgcttttatggtcattaaaagtacgatacctgttggttatacgatttccgtacgtgagcggtttcatacaaagcgtattctttttagtccggagttcttgagagagtctaaggctttgtatgataatttgtatcctagccggatcatcgtgggtacggatttgtctgatccggaattggtagatgccgctcatatttttgctgaactgttgcaagaaggtgctataaaagaaaatatagataccttatttatggggttgacagaagctgaggccgtaaaactattcgcaaatacatatcttgcactacgtgtttcttattttaatgagttggatacgtatgcggaaatgaaggggttggatactcaatcgatcataaatggtgtgtgtttggatcctcgtatcggtaatcactataataatccttcttttggctatggggggtattgtctgccgaaagatacaaaacaattactcgctaattatgcggatgtgcccgaaaatttgatagaagcgattgtggagagtaaccggactaggaaagactttatagcagatcaagtacttcgtatggcggattattatgcttacggggaagagaatgaatggagtagtgtacgggaacatcctgttacgatcggtgtttatcgattgacgatgaagtctaattctgataattttagacaatcttctattcaaggaataatgaaacgagtgaaagcaaaaggagctactgtgattgtttatgaaccagccttgtcggataatactacattctttgggtcagaagttgttaatgatttggatctctttaaaaaacgtagtgcggctattatagccaatcgatatgatgtggaattggatgatgtgaaaaataaggtatatacacgagatgtatatagaagggattaatctaaattagggttagcgtccaaaaatgacgtatagcatcattcaacagaaatatagatctttgttccgctaattaaaacccaattaatatgtagagcaataacaattctgaaatttttttcctccgctacaaatccgaagcggtcacgaacaaggattccatccgatccttctgttttagaaataaggtaccgtataacctgtttgaaaaatggttaagatgttttcataggagatgggttgaaatccgtacatttaaggaggctgaacatcaactgtgcctgtcacatgtccgggctaatatgttaaagcgtatgatcaaggaggtgaaaagagagccttggtctttacggacagtttggatttcttctttagaaaggaacgtgattataatgaagagaatcttattcttgaagaaagagtctgatgatcacttactatgcaatgtaacagtatgttacactttggtcgtgacgaaggtgtagaaatggcagctgcatatcatggtgtaatcagtactgtgaggctgcaagggaagtgagcctgggatttccttggtgaatttttcaaaaatatttttaatggttgtaaggactttgttaatctcataccccagaatatagagttggtatgtactgatagttgaatttgatgttttttaatataaaattagataggtgctacaaaagagcctatacattagtacatgctctaatttgagtaccaacaaaggtgttgcgtgattgccataaattaattaggaaagcactattggcgatttacttttgtttatgtggagtcgatttttaagatatctcctcttctatgtcttcaactctcatggtaccaatcatgggagtacatatcgccgatatgcttatcggtataacgccaaaaaagaaagaggaacttccatggaagtgtttgcaagaaatgagaaccacaaaggtgcgatgatgaatgtgtagatgatagaatagactgtagaatcgatatagaataaagattttgtaccggtcttctttctcccttcggggaggtaaggaggccggttctatttttatgtatgccttgatgatccgtatataaatgtgggattcggccttctgcggcgcagggataaatattccccctgtgaccgtggaaatgaaaaatcttatgaaagatttgaagggactgttgggcgagtttcggggttggcctaccgttgagttgtttagtgagcgtctggccggattgtcggcggaagatagggacaggcatttgctggggttttgcaagctgactttcgggcattatgaggagttgccgacgggatatcggaaattggtggatggttatttggatggggagcgaggggagaacttgatggtgtggtatttgacaaggcatacgccgtggaagaatgcccgttatgagttgcatcgaccggacttgtttttgcggatggcgaagctggtggagtttacggatcgggatgggcgtttgccttattctcatttggcggcttgtttatgtatggcgttttccgtccggagtttatcggatcctaattcggaggtcttgccgaaatccttggctagccgtttgagcgcattgaatatattaccaagtgatattttggaactggcggggaagagggaaataacggatgagatgtgattctttattgataaatgttaaatgtacgtggattgaagtcgatgaaatttggtgtgtttttcgttgatttgggaatgtgtgtgttggctgctaggtcgttaactgttttgcgtcatcgaagtcaggctttgtggctattatacctttgtcatgtgttcgaagcatggttacattcatttattcattaaaaacgtatagttatggcattgaaatttaaattggtaatgagaaagaatctaggtgaggatcacgaatctattcccgaaaaggtatacgctcaaatggtgtatggagatctagttactttcgatgaatttgcggaggaggtggcggatagctctggtgtaggtagcgctagcgtgaaggcggttctggatcgtatgaatgtggtgttagtccgtcatttacagcatggcagacgtgtcagtgtaggtgagctgggacttttccgcttttgtttcggatcgtcgggggtgccggatgagaagacgttttcgacgaacttgattcgggagccgaaagtacggttctacccgggcaaggcgctacgggtagccaagagccggacaagttttgagaagactgcgcttccgaatgaagaagatgcgggtggaaacgggagtgatagtgaaagtccggatgaaatctaagagctatgaggcgtttgacggttcaattaattgtcgcgatcctgctctcaatgagcgggatcacacttctcttcagcggattctggattgatccgcaaggattgatcgataacagcgtactggtggctttcggtgagatcagtacgtttgccggggccctttttggggtggactactcttataaattgaaaattaataattgaaaattgaaaattatggaaagacatgataaaaggttaacagagcatttttgtttggatgagtttacttatagtggtattgccgtggacaatgcgataaataatcagcctcctccttgtgcatgtctagcgcttcaaaatttggcagttggtttattggaaccattacgtctattgtatggggcaccgattgctatattgagtggatatcggaatgagaaggtaaatcgtcttgctggcggggtcgttaccagccaacacttgaaaggagaagcggcagattgctatgttgccgatgggccggaaaaattgttggatgtgttgcaatgttccggtttagtatttgaccaagctatattatatagacgaaaacgttttttgcatctttccttaaagataaatggaaataacaggatgcaagtgttagtttataacaaatcttgatacttcggtgcggaaagagacttgcccatgatcaagtgcggaagggaagatcggtgatttggtggactgaaaaggatatgatatatttgcctcctatgattaagcttgaatatctaaaaaagatacgtgttcgttggattatattggcgatttttcttgtcgctatatggatcgtgatgggaaatcccagattaggcgaatggtattcccgttcgatttatccatgggtatcgggtatgctatctcgtttctcctgcttgttccctttttccgtaggggattgttttatttatggtagcatcgccgggttattagggtatctgtcgtatgcgattataaggaggcggaggatcgggaggacaataaggcatgtcgtggaatatctggcatgggtgtatgtctggttctatatcgcttggggattgaattatttccgggaagattttttcactcgtacgcgaaccacttatgtgcctttttcctcggaacatttccaatccttcttggatgcctacacggattccctgaacgcctcatgggttccgatagagacgatcgatcgggaggtcgtgaaagaggcggtgcaggaagggtatcgggaattgcctactcgtttcgggcttaccactcccggaacctatcttcatcctaaaacgatgctgttctcccggttgatgagtggagtaggggtgatgggatatatggggccgtttttcacggagttcaatttgaacggccagctcttgcccgtgcaatatcccgccacttacgcccatgagatggcccatgtgcttagtatatccaatgaggccgaggctaatctatacagttatttaatatgtacgggctcttccgtgccggagattcgcttctcaggctacttctccttgctgccttatgtattgagcaacgcatatgtggctttggataaggactcttttgaggcatggaagaaaaggttacgccccgagatcaaggaattgtataacgagaaagtcgcctattggcaatctctatacagcccgttggtcggcgaggcgcaagacgtggtctataatcttttcctgaaaggcaataagatacctactggaaccgctaattattcggaggtgatcgccttattgatcgccttggaaggagaatgatttattcatcatttaacttcctccaaataaagcacccggctcgagtaatcattctgtttatgataatcgacaatgtgattataagggatttccagtccgttcgccatgagatattccccggtgaaagctttaccctcgaaggccagaggctcgttgtcgatccggttcagttcgcagactctgtatttcttgtctggggataatccgttcatctttacacggggtaaatgttggttgacgaaatgctcggtcttccaccaataaaatacggctttgtctttctccggtgaggtgtacatcaaggaagctactcccaaaccatcgtaaggagaaaccagacggtagatatcgccgaattgcacgatggggcggatcgtcttataatcggcgattgccttgcggcaaagcattttctcttcttccgtcatattcttgggttggatctccatgcccagacgaccgctcatcgctacgtcgatccgatatttcaagggaatgacccggaatgtttgatggttgggggcggcgctgatgtgtgaggccatggcgatagccgggaaaaaataagaagtaccccattgcatatagatacgctgtaaggcatcggtattgtcgcttacccaaaactcatcgaagtaaggcatgacaccgtaatttgcccggcctccaccgctggcgcaagcctgtagggttaaatccgggtatttggctcggatacgctcacagactttcttgaatccttcgtgatattcgatatacatatggctttgctgatccgaaggcagatattgggagccatggttcaggatgctcatattggcgtcccatttgatataatcgatctccgggtatgttgtcatcaagttgtcgacgataccgaatatgaagtcttgcacctcgggattggagagatcaagaacgacctgtgtaccgccacgccccaggacgatttccctgtttggagctttcaatacccattccggatgcttctcgtacaattcacttgtcgtgttggccatttccggctcgatccagataccgaatttaataccatgcttgttggcgtcggcgattaggccctcgatgcctcttggtagttttcgggcatcaaccatccaatcccctaaggacgagttatctttattacgaggatatttatcgccaaaccagccgtcgtccatgacgaacaactcgccgcccatagactggatatcactcatcatttggtccataccttcttgattgatatcgaaatatacaccttcccaactgtttagtaagattttccgggcggtcgctccattcgctatcttatgtttgcgtgcccatgcgtggaaatttcggctgcttccgcttaagccgtccttactgtaagtcagcgccaattccggtgtacggaaactttctttggctttgagggtgtaagccgagttctcctcgtttattcccgcgaagaaatggtgatagtcgctatcatccgtatcgaagaataatttgtagttaccgctatagcatagggcggcgccaataacggaaccggtgttttccatcggcttcccgtctagggagatcatcacttcggcgtgggcggtatgggagttgcggacaccatccttgttttttatcatcttgatccccggccgtaacggttcttgtgccaattgagcctcgtttgcccatgagccgtataagtgggaaacccatacgtctcctttcctgatcggcagataagcggaagcgaaacgattgagggtgatcgcttttttctcctcatgcgtgatctctgtccaagtctcgatgatatcggcgtccggataggttctgtaacagagattcatataaaaaggatacactttatcttttaatcggatcgtcgtgatatctgccgtttgctcttttcgtgtatctacttttatgacttccagttgaagggtcatattcccgtcaccatgggtaacggacaatgcgctttcggaggggcaattcaagccgtagaccggataagcggaaaatgttttctgctcggtctcgagcaaggtagccgcgtcggaagtggataacttgtctccatagtagatgaatcttacctctccgccgacaggtgcgtctagcaataatgaggtattcctcgtggaaatcaatacgtcttgtgcccataaactagtggtcaatagggaggcgcaacataaataaccgaatttactcttaatgttcattttattagtaggtgttagatttaaattcaggggcaaaagtaggagagagccggtaggtttcctaataggattttatcagatactgttacttttctgctttaactaaaatttgtttcacgcagaagaatcccgtgctttcattaatgaaaattccatattgtctaattcgaaagaaatcactaactttgcggcaattttttagaagcaagataaatacatcgcgatatgagtaagaaatttaccgaatattctaagtttgacttgtcgaacgtaaataaagaggtgctgaagaaatggaaggatggagacatcttccataagagtcttgaaacaagagagggacatcctacattcgtattctacgagggccctccatccgcaaacggtatgccgggtattcaccatgttatcgcccgttcgattaaggatattttctgccgctataaaaccatgaagggattcttggtgaatcgtaaggcgggttgggatacacacggtctgcctgtcgagttaggcgtggagaaggctttgggcatcacgaaggaagatatcggtaagaagatttctgtcgctgagtataacgccgcttgccgtaaggacgtgatgaagttcacgaaagagtgggaggatttgacgcagaagatgggttattgggtggatatggagaatccgtatatcacatatgataaccgctatatcgagaccttgtggtatctattgaaagaactttataagaaaggtcttttatataaaggctatacgatccaaccgtattctcccgccgcgggtacgggcttgagcacgcacgagttgaaccaaccgggttgctaccgtgacgtgaaggatacgacttgtacggcgcaattcctgattttggacccgaagccggagatggcggagtttggtgatcctttcttcttggcttggacgacgactccttggacgttgccttcgaatacggcgctttgcgttgggcctaattttacatatgtagccgtacagacttataatccatacaccggtatgcctatgacggcggtgttggcgaaggatttgttgaacgtttatttcaacccgaaagccgccgaactaaacttgtcggattataaggtgggagataagttgatcccgttccgtgtcgtaggtgaatggaaagggccggaattggctggtatgcattatgagcaattgatcccgtgggtgaacccgggtcagaatgcgttccgcgtgatcacgggcgactatgtgaccgtggaagacggtacgggtatcgtacatatcgccccgacattcggtgcggatgatgatcgtgtggcgaaagccagcggtatccctcctttgatgatgatcgataaggatggcaaccaacgcccgatggtggatatgaccggtaaattctataagttggaagacttggatccggagtttgttcaggatcgtatgaatgcctccgactatgatccgtggcaaggtaagttcgtgaagaacgcttacgatgatacgaagacggataaagatgagacgttagatatagagatctgcatgatgttgaaagcccagaaccgggtattcaagatcgagaagcatgtccacaattacccgcattgctggcgtaccgataaaccggtattgtattatccgttggatagctggtttatccgcacgaccgcttgccgcgagcgtatgatcgagctgaacaatacgatcaactggaaaccgcagagtacgggtacgggacgtttcggtaaatggctggagaacttgcaagactggaacttgagccgcagccgttattggggtactccgttaccgatctggcgtacggaagacggtagcgaggagaagtgtatcggttccgtggtagagttgtttggcgagatcgagaaatcggtgaaggccggctttatggagtctaacccttataaggacttcgctccgggagattatacgaaggagaactacgagaagatcgatttgcaccgtccgtatgtggatgatattatcttggtttccgcttccggcaagccgatgaagcgtgagacggacttgatcgacgtatggttcgattccggcgctatgccttatgcgcagattcactatccgttcgagaacttgaaggagttcgacaaccgtcagatctatccggccgactttatcgctgagggtgttgatcaaacacgtggttggttctttaccctgcacgctctgggtaccatgatctttgatagcgtggcttacaaggctgtcgtgtctaacggtttggtattggataagaacggaaacaagatgtctaaacgtttgggcaatgctgttgatccattctctacgatcgagaagtatggctctgatccgttgcgttggtacatgatcacgaacgcttcaccatgggataatattaagtttgatatcgatggtatcgaggaagttcgccgtaagttctttggtacattatataatacgtattcattcttcgctttgtacgcgaacgtggatggcttcgattattccgatccggatgtggaatggagcaagcgtccggagatcgaccgctggatcctttctctgttgaacagcttggtgaaggatgtggatggctacttggaggcttacgagccgactcgtgccggacgtgctatctctgatttcgtaaatgataacttgagtaactggtatgtgcgtttgaaccgccgtcgtttttggggtggtggcatgacggaggataagttgtccgcttaccagactttatatacttgcttggagacagtggctaagttgatggctccgatcgctccgttctatgccgatcagttgttcttggacttgatcgctgttacgggacgtgagaacgttgagtccgtacacttgtccgatttcccggcttacgacgagtctaagatcgataagaatctggaagagcgtatgcaaatggctcaagatgtttcttctatggtattggcacttcgccgtaaggtgaatatcaaagttcgtcagccgttgcagaccgtaatggttccggtggtagacgctcatcagcaagagagcatcgaggccgtgaagaacctgatcctgaacgaggtgaatgtgaaggaactgaagttcgtggataatacggcaggtatcttggtgaagaagatcaagccggactttaagaagttgggcccgcgctacggaaagatcatgaaggcgttggccgccacgatccagacgatgagccaagaggatatcaacgctttcgagaaagccgggacgtttaccttgacgatagatggacaggaggcggttttggagcgtgcggatgtagagatcatctctgaggatatcccgggttggttggtcgctaacgaaggtcgcctgacagtcgctttggatattaccgtaaccgaggatttgcgtaaggaggggctggcccgtgagttggtgaatcgtatccagaacttacgtaagagcagcggttttgatataacggataagatccatgtatccattctttcttacgaggagatggatgaggcgatccatgattataaggattatatcgctaaccaagtattggcggaatctatcgaaatcatggataatgcgatcagcgacgctacggaactcgatttcgaggactttaaattgtccgtaaagatcgagaaagcttaaaaatagaatagcatttcttgcggaagaattaggaatgaaatataggaaaatcgataattatattatctttgcatgcaaagaagaaataatatgattttatattcattcttaattcttctttttgattgatatttgaacgattgttgaacctaaatttttttagaaccatggcagagaagacaagatattcagacgctgagctcgaggagttccgcgctattatattagagaaactggaaatcgcgaagagggattacgagcttttgcgatcaggggttacgaattccgacggtaacgacgtggctgatacgtctcctacattcaaggtgctggaggaaggcgcttctacgttatcgaaggaagaggcgggtcgtttagcgcaacgccagatgaaattcatccagaatttacaggccgctttgatccgtatcgagaataagacctacggtatttgccgggagactggtaaattgatcccgaaagaaaggctacgtgccgtgcctcatgcgactttaagtatcgaagcaaaacaaggaggtgcaaagtaaatgagatattctaaaggttggggagcagtgttaatcataatactgctccttcttcttgaccaagcgctgaaaatatggattaagacccatatgcagttgcatgagagcatagagataactccgtggttttatctttattttaccgagaatccgggtatggcgttcggtatagaggtgatcgggaaattgttcctttccgtattccgtatcgtggctgtattgtttatcggatattatttgtataagctggttaaagagaattataagttcggttttattgcctgtatatctttggttttcgccggggcggtgggtaatataatcgactcgatattctatggcgtgatcttcgatcatagtttcgggcaactcgctacttttatgccggagggaggaggttatgcctcttggttgcatgggaaggtggtggatatgttctatttcccattgatagagaccgtattcccggattgggtgccgatctggggtggacaggagttcgttttcttccgtccgatctttaatttggcggactcggcgatttgcgtgggagttttccttttgttaatattttatcggcatactttgtcggctagcctttcgaaagaagagaaataaatgcggagaaaattacggatatatggtatggctttattagccacgacgttgctggcggcatgtagtaaggttccggatggtattctgtcggagaaaaagatgcagggtgtcttgacggatatgttgctggctgaggccatggtaaatgtggattataatacttataaatccgataccatgaagcttgccttgtatgagtctgtattccgtaagcatgatattacacaagcggtgtatgatagctcgttggtgtggtacggccgtaacttggatatttatatggaggtctacaaccgagtcttggccgatcttaataaacggatcaataacttaggggatgtgcaggcggacgctgcgccggtatcgaaccgggattctgtggatatttggcctcgccgttcttatctggtcttgtctcctacctctgtatttaatggggtgactttcgatatacgtccggaaacgaattattcctcgggcagtagtttcgtgctgggcatgcgtgtctggggattgaataacaaaatggcttataagccggaggtacgtttaagcgcggaccaaggtgatacgaccttgacggtgaatagtaagatcacgaaagatggatatcacgagacgatcttgaagactataccaactaagaaagtaaagcgtgtgtttggatatatccgtatggataatatggatacgacttattataaggtgtatatagatagcttaagcttgatgaaatataactatggtaaggagcttgccgaattacctaaggattctattaagtaatctctctatttgtttattgtacttatgagaagaattgccgctcattacgtttggtgtaagcaggtttatcgtatgcattatatcgaactggatgataatggtgcgtttcatggtgtttacccgttgaatgaggagatagctggaaccgctttttatgatggagtgctggtgccggttctttcctcggaaccggcgattggttttaagcaggtgatgggatcttggccggcgttaaccgaaaagattacgccgggttgttcagtccatatatatcgtttaagcgggattcccttggcgtctgcgaaactcggcacagaccacggctgtagcgatggccacattgagagactctgatgtgtctcttccttccggatagttcgggatatataatttttcgtttacaaaagcctctatggcgggacgtattccatttccttcattacccattatcaagataccgtttccggataaggttttctcatataagttttctccgccaaggaaggtgccgtataaaggtatggcttgggcagattgggcctgtaagaacgtttccagatcggtgtaatgtatttttacgtgggcgagcgcacccatagtggcttgtacggtttttggactgaaaacatcggcggtatctttgctgcatacgatatgggaaataccgaaccagtccgctaaccggatgatcgtacctaagttgcccggatcttggattccgtctaatgcgagaacaagctccttttccggcgttatttccgttatatcccaattggggcgtttaaagatcgcgagtacatcttggggatttttcaggaagctggctttacgaatatcatctttttccgctaccaataactccttggccggaatatcgccttgtgtagccatccaagatggcttggctattaataactcacattcaaaggccggtaacatatcggctaccaatttatttccttcggctacgaaaacattattttcattccggaatttctttaattccagagaacggatgtatttgactttggtcttgcttagcatcttagttctttttacaaaacaaaagtacggtaaattctttaaattccagtacattcgcgatcgtaaaaagcttggaatgatgaatcgatctctacgtatatgctattttatctgtatcgtactactgctagcctcttgtagtacgaccaagtttgtgccggatggggaatatttgctggataaggtggagatcgtgtcggataacaaggattataagtctgcggatttaaaatcttatcttaggcagcaaccaaacttcaaggtgtttggtctgatgaagtggcagttgtttgtctatgattggtctggtaagaatgagaagaaatggatcaataaacagttacgtaggattggtgagcctcccgtggtgctggatacgatgttggtggaacagtccgccatggaactagagcgtttttacattaataaagggtatgtccatgcggatgtatcaacgacgatcgatacgacacgccataagaaagcggttgtaacttaccatataaaggcgaacgatccatataggatacgcaattacacgatgaagttccccgatccgaaaattgatagtttggcacatctgaaagcgcctcgccgctctcccttagcttctgcgttccggtcctcacaggaagagtataaccaattagttaaggaaggaactttatttgaccgggatatattggacaaggagcgggagcgtattacgaccttacttcgctggaacgggtattatggttttaatcgggattatttaggatatatcgctgatagttcttttaaccaaaatgtcgtggatcttgatatgtccatgaaaccttatcggaaggtgttgcccaatgggtcggtagaggatcagccgcatcgtcagtattatattaaggatgtaacggtcttaaccgattataatccgatgggggtaggagaggacgctagtttcatggctacagatacgatgctcagcgcaggggtgaatatcgtatatggccggaacgggaagagtatccgtccgagcgtgctccggaggagtacttatattcgtccggggcaattatttagtgagaagaatatagagcagacctattcagcgttcgcttctctaagggctttgaggaatgtaaatatacgttttacggaagtagaggagcgggatacgatgaagttggattgttacattctcacttctcctgcgaagataaatacggtgggagtggatttggaaggtactaactcggcgggtgattatgggtttgcctccagcttgaattatcagcataggaatatcttccgaggatcggagctattctcggcgagggtgagaggggcttacgaggcgttatccggaaataaggcgaatggctttggtaattactgggagttaggtgcggaagggtccttgctgtttcctcgtttcttgttcccattcttgagttcggattttcgtaggcggctacgtgcgtcaactgaagcgaaaataagttacaacctgcaaaaacgtccggagtatacgagggcgattctatctggtggttggagttatatttggcaagatcggggcaatacacaggcacgccatacctttaagcttgtagacttgaattatgtgtatttgccggataagaatatggactttatcaatagcttgccggattatatggtgttgtataactatacgaaccattttatcatgagttcgggatatacttattccttcagtaattattctccccagaatcgtttgagaaacacgcattccctacgtgcgtcggtcgaggtcgcagggaatttgttgagtgccttttcgcatcttacgggggcgaagaaaaatgatgacggttattatgagttgtttggtacggaatatgcgcaatatgtgaaattggatttcgattttagtaaaggaatcgtgcttgacagtcgtaacaagttagctttccatataggagtgggagtggggatggcttatggtaactcaaactatttaccttttgagcgtgcttatttctcggggggagcgaatagtgtccggggatggtctgtacgagagttaggtccgggtagtatggaagttgacagcacgacttctttcgctcttcaatcgggggatatccgcttggatttgaacttggaatatcgaacgaaacttttttggaagtttgaattggcggcttacatagatgccggaaacatatggacccggaatgtatcagatgaacgctataaggctggaaactttgatttctctcgtttttacaaggagatcgctgtttcctatggtttgggacttcgtttggactttgatttctttctactacgtttagatacaggcttcaaggcttataatcctcaggagaaaaagtctaggcgttgggcgataacccgtcctaatttcaaggataatttcgccttgcattttgccgttggttatccattctaaattcaatatgtaaaaaagtgtactaaaagtttgcaaggaaaagaaaaatccttacctttgcaccacgaaaataaggatggtcaggtagctcagctggatagagcaacagccttctaagctgtgggtcctgggttcgaatcccagcccgatcacgagggagactcttttagagtctccctttttttgttataatcagatgccagtttttttcttttgcttgttttgatcgttgtttattgatcttttatggaaaactttgagtgttatctatcggttattatatagaagatttcgagatagaatttcataattttgtttttgatgggataagggctattaagcaggattcctgtatttgagattaaacagattgtaaatatttaaaaagtagataagatggaaacatttgacgatatcattaaaggggataaacctgtattggtggatttttttgcgacatggtgcggcccgtgtaaggtgttgagtccgacggtcgaggcattggggaaggagttggcgggacaagtgcgtgtccttaaaattgatgtagataagaacgaggcacttgccacacagttgaggatccaatccgtacccactttgatcatctttaagaaaggtgagatcgtatggcgctcttccggcgtgatggatcacggaagcctattgcggaaggcgcaaagctatatcgattaaaagccgttcatcgggatcaataccgttgggatcaataataggaatccaaggatcactaggacaaggatgaacttccatgcccatttgaaccatttatcgtaggggatacggcttactcctagaaccgctatcagaacaccagatgtgggagttatcagattcgtgaagccatcgccaaactgaaaggccatgacggtggcttgcttggataaaccgatcaactccgagaatggggccatgataggcatggtaagggccgctttggcgcttccggaaggaataactaaattgataagcgtttgaataacgtacatcatcccgaccgtagctacttgtcccaaaccttccatccctttcgctaggttaaagagaatcgtatcgatcactttaccgtcttgcaggattacgataatacctccagccaagccaacgactaaggcggcgctcataatatccttgcagccctctaagaatagtttcacaagctcattcggatcgcgtccattggcaattcccgccgctatgcccaaggcgaagaacaaggtcgctatttccataatataccaaccgtagcccattacgcctgttatcaagaaaaagatcgtgaagaataaaaggttcaatatatataagtgcacggttttccgtagggtaaatatcgagctgatcacgaacgctacgctaagaatcggaattaagggtagtcccttgattacgctatttcctatttttaaggatgtctgggggtaatagaacgaaaagataacgagtacgatagccaataggacgaaactgatccatgcggctttcggggttctgtatacgatttccaaggaattggtactatgcaaatctctccaatattgatcatcctcatagactggtgacaattgagggttcttttttaccttggcggcataacgcaatatccatgtgaagcctaccgcattgataatacaccagcaaacgatgcgatactcgataccggagaaaagaggaatccccgccaagccttgcgctataccgatcgtgaaagggtttaaaatcgctccggcgaaacctaatcccgccgctataaaaaccatacatacgccagttatggaatcgtaccccatagatatcgccatcgggaccaagaccagacaaaaagcgatggtctcctcactcatcccgaatacagccccgaatatactgaaaagtaacatgatggcggtcaataagaaattatctatgcctattttacgaaggatagggttgttctccattttgcgtgctttccgcaggaaactgactgttccgatatcaaatgccttactgtcgttcacgatccagaatgccccgccgatgataaggataaagacaatgatatccgccttgtccacaaatcctttataaaaggcggagagtacttcccaagtctgaggtacgctttccacggattcatatacaacggttcgctctccgtccgggctgatactttccgtatattgcccaccgggaataacccatgtcaatatggcgcaaaataagatgatgtaaaagataattacgtatgtgtggggtatttgtctctttttcatgattctgttttttcgtcttcttctgttaatattccgatctcgggaaggatagcccgggcctcacggtcactaagcgtatctacgtctttgagtttacgttggatggcacgggtacgggtacctaaaacctcttctatttgcccgctggcggtttgcaagttcttttgggctttctcgagcataccgcctactttctcgaattcttttttcacggcccctaagatcgtccatacctcccctgagtgcttttggatcgccaatgtacggaagcccatttgtaaactgtttagtatggccgctagggtagtgggacctgttacgactaccttgtagtttcgttgcaagtcctccaataaagcggaacggcgtacgacctcggcgtaaatgccctcgaacggcaggaacataatgccgaaatcggtcgtggcgggaggcgccagatatttgtccgaaatatctttagccatcttcttgatcgttgtctccaataattttccggctgtctcgatcgcttgggaatctgcggcatcgtaagcgtctaggagctgttcgtatacatctttcgggaatttagcgtctatgggaaggtatacgaattctcgggcatcatcccgcccggggagcttgacagcgaattcaacgacagcatccgaacctttccgggtatgtacattcgcctcgtattgctctggtgccaataactgctccaataacatactgagttggatctccccgatatttccccgggtcttaacattactaagtacccgttttaacccgcctacatcctgcgctaaggtttgcatctcgcccagtcctttttgtacactttctaattgttcggtgactaaacggaaagattgcccgatacggtcgttcaatgtcttttgaagtttctcgtctacggtgactcggatttcttccagtcttttttccgtgttatccactaatctctgctggcgttcgtccaaggcggcgaatttctctttctgcaacctgttaaaagaatcgataccacgttcgaaagcttccctgaactcgttcatggaatgagccagttcttctcggttatctttcgctaccaaacggctttcttcccggttcaggcggaagtcttccctaaagtttttctcgatacggtcgaacgagcgttgtatctcgtttagcaacttttctaggtcttctttgttattatttagctgtttaggacgcaaaaggatttgcatcacgatgattataagaagtccgccgataataatccaatccatctgtttttgattttgacgtcaaagatagataatctgtattttgcaacagcagttaaatagagttaaataaaagaacattgtttattttcgtttgttttatcgacagaaagctgcttatatttgtgcagccaacttaagtaagactattaaatttacatacaaagatggcaaaagtaacattaaaaggtaacgaaattcatacgaacggcgagttgccgaaagttgggacagaggctccggacttcaagggtgtaaaaagtgatttatccgaattgtcgttaagcgacttgaaaggaaagaaagtggtgataaatgttttcccgagcttggatacaagtgtatgtgcggcctcggtaagacgcttcaataaagaagccgcttcgcatccggatacggtagtattagctgtttctaaagatttaccttttgcgcatggacgtttctgtactacggaaggtattgataaagtgattacattgtcagtgttccggtgttcatgttttgaggataagtacgggatgcttctggtagacggtccgctgaaagggttattagcccgtggcgtgatagtagtcgatggagctggtaaggtggtttatgaggaacttgttcccgagattactaccgagccgaattacgacgcggctttggcggcgttgaaataaatatagtagattattgtttttcattggttaaagttaagggttagtgtaggaggccgtcggatgtgaatcccgcggccttcgtttttgtgtgaagaggctaaagttttccttccagctcgtcgacgatttgcccatcgaagagattgatgatacggtcggcgtaggtcgcgtcatgttgcgagtgtgtcaccatgacgatcgtagtcccttcggcattcagttgactgagtaatttcataatttcaagactgtttttagagtcgaggtttccagtcggttcgtccgccaatatcagcatcggtttacctacgacggcgcgagcgatggcgacacgttgctgctggccgccggagagttgctgcggataatgtttggcacgttggctgaggcgtactttgcgcaggatgtcgagtacttgttgtttgcgctcagccttggggatgccgaggtatttcaattggaggtctacgttttcctcgactgtaagctcgtcaatgagattgaagctttggaacacgaaaccaatgcgtcccttacgatagcgtgtacggtctttctcctttaggtgtcccgcctcttcgccttctaatagatagctgccctcgtccgggttatctagcaggccgagaatatgcagcagggttgatttgccgcatccgctgggtcccatgatggcgatgaactcgccctttttcacttccatgcttatgccattgagcgcaatggtttctacttcttccgtccggaagtttttgctgaggttctttatttgaatcatgacttgtcttgtttttgtgagaatgtatacctattatagaatgttgcttttattcggtccggatacttttgatggggttacggcgggcgactttcaaggtttgcccgatgattgacacgaaagcgatggctatggttgccaaaactgccgcggttatgagataccacgggaaggcgatgcggttatagaacgactctaaactgatttgaaccgctttcacgctgatgggcagggcgaaacaggcggcaagcaacgagagtgccatgaatcgtttggaaagttcccataccgcgccacttgtttcggctcccatcaccttgcacaaggcgatccgtttgctttgctgttcggtgtagcttatcgacatggccagcagtcccaaggcagagatgagaatggagatggtcatgaagcaaaggacaagcatcagcgtgttcttctcatgggttaaatccttgtccatataatcgtcgatataatcggcttccaagtctttcggtatcccgatcacttcattggacacttccctgcaagtgcggcggatggcggctaaggcttccgcccgatcgccttgtgtcttgacgatttgacggatgatgtagccttgtgggttcaacaccataacggctccatgcgaatcgggttggggtgtgttcaacgcgcccagcgaacgatagttgcggatgacaccacagacgttgtatcgatagccgcccttgtcgctgttttttccaaaatggggtctgccggatgaaagctggtaacgacggcaagtctcttccgttacccaaaccatgccgggcagtgggtcagaccaacgttctaccacttcgaagcccaacagccggaatgcggcgctgtccatatccgaaaggtggagccacgagtatccttcttcttccgattgcagtacaccatcgtgaccagtgaagaaaggcagttttcgtgccaatgctacttctgtcacttggggcaatgcctgtaaacgtttctggaggatgacttgcttgtcgtaggtgtgtcccaagtcccatgtcttgacgaataccaggtctgtattataaccggtcggcagggtggcaaggtggtatatttggaaggccatggtgagtcccaaggtgatgagtaccgtgctgatgatattctgcacgatgatgaacaagcggctgaacagttgcttgttgtgcatgcggaaatttccttttacgatatctatcggactgtatttgtaggtgatgatggctggtaacaatcccgatatgccggcgattcctacccatagcaacagcgaataggctaccatcgccggtgaagagaccaaagcgatccgggaggagagcaagtactcgaaatagggctttgtgatgacggcaactaagcaaccgccgatgaaacaaccggttgtgaagatagcggactctgcgaggtagcgtaatacgatttgccctgccgagtcacccatcaaccggcgggtcgccatttcatgggctcgtttgctggtttgcgatacagttaggttgatgtaattgaagatagccgagaggagcaacacgaatgctaacgagaacaagatttgtacctgtttccgtgtccctttacggaaagggccgtattggttcaggggagagaaataaatctcgtccatgcgtgtcaccgaagaaccccaaaaaagcctgttcgtgctgttgtcttctttccagtattcccaatagcctttatacttatcgagtagtttacgggtaacaacatcgggagttaccccttcttccaacgtaatgagtatttgcgttgaaccataactgtccatccatgcataatccttttctgccagtttgaaaggaatcaagatgtctatcggtttcaacagctctgtcgagctgaaagccgggagaaccccaatgacccgtagcggtgtctggttcaagtacatcacggtacggccgatcggattttcattcccgaatactttgtgggcgaatggctcggagaggatgacctcgtctgtcccgatcagtgctttgttgcggtcgcatccaatgagcgtatagttgagcatctggaaaaaattaggatctgccgcgatgccgtttacttgataatattggttgtctatcatgaagtcggccgcttcaatatggatcaggcgtgtccactcttttatttccggaatggaagggaacaattccggggcagtcccggttgtcataccgatcccatctccatagccgacggcatacaattggtgagagtatgattgattgttaccgatattaaattcggtgtcggcatacgaggtcagaaggatgacaactcccagtgcgatagctaatccgaagaactggatggctgtgtagagtttgttgcggccgagaaaggtaaagtacgatttcatattttgcttgtttttgatacaaaggtatagagcggttggcatctggcaagggcttggatgcccggttgcggtagtttgtatgaaaatcatacacccgcttgtatgatattcatacagcctttttccgtacctttatccccgataaaagagataaaggaaaacaaacgaatcggatatggcgaattacgggacaatattggtggtagatgacaatccggcgattcttacggcggtcaagatctgcttggccggtgagtttgacagggtattgacactcgcttctcccgacacgcttcttacggtattggcacaagaggtggtggatgggattttgctcgacatgaacttcacgcaagggggaaactccggacaagacggcttgctttggcttcgggcgatccacaagaagcatccggctatcccggtggtactggtgacggcatacgctgatatcaagttggcggtgcgtggtttgaagatgggagcggcagactttgttgccaagccgtgggataatcaagagctgatccgtgtcttaaaagatgcgattgatgccgggcgtaaagtggttccattggaacaggtcgaggcggaacatgtgagcaaggtggtggagtgttgccacggcaatatcagccgggccgccgaattgttgggaattacccggcagacgttgtatgctaaaataaaaaagcgatgatgttgataggcactttgggagtcgttgtcgttctctttatcggatggttctaccgccatcaggtattgttgagagaccgggcgcatctgatgcgtgaggcgattcgtaaccaagaatttacgtttcgtcttcctgtgaaaggcctgttcttcggggagcgggcgttgcaagaggcccttaacgagacgggcagggacatcgggcagttgcttgcccgcaatgaggtggaatcgtggcaacggctgacccgtgtgcttacgcatgagattatgaatgccactacgcctatcgccagtatcagccaggcctatctggagcatcccgcgattgccgggacggtttacgaggaggggatccgtgccattcacgataccagccggggacttgccctgttcgtggacagctaccggaaactggcggaactgcaagaacctgttatcggagaggtctatttgaatgattttatggaagggatccgggctctttatcccgatttagagtggcatctttccatccctttgtctgctacgatgtgtacggatcagaatatgttgcggcaagtgctgattaacctgatccggaatgcttgcgaggcaggggctacgaccgtggatgtgcgttggaagaaggggttgtgggtcagcaacaatggtgcgcctattccggtggctatcgaacgggagatttttattcctttcttcacgactaaaaggacgggttccggtatcggcttgtcgctttcccggcagatgatggtgcggcaaggcggggatctttgtttggcgcagcgttctgtgccgggttatcaagtgacgtttataatttcttgcgtaggataaatttaggataggatatgaatcggaaaatacttcagctggccataccttctatcgtctccaatataaccgtgcctttgttgggcctggtggatgtggcgatcgtagggcatctgggatcggcgtcgtacattggggcgatcgccgtgggcggtatgctgtttaatatgatctattggatattcggctttctccggatggggacaagtgggatgaccgcccaagcctacgggaaacgggacttgacggaggtagtccggaccttgctgcgggctgtcggggtagggcttttgatctccctcgggctttggatccttcaatccccgatcctgaggggtgcgttcgttttgatcgatgcgacggagggggtgaagcgatgggcctctctctattttaatatctgtatctggggagcgccggccgtattaggattatatggctttgccggttggttcatcggtatgcagaattctcgtttcccaatgtttatcgctatcacgcagaatatcgtgaatattgtggccagcctatgtttcgtgtttgtgctgggtatgaaagtggaaggtgtagcgctgggaacactgatcgcccaatatgcgggcctcttcatggcgtttgctctttggttgaaatattatgggcgtctgaaagcgtatatcgattgggacggtctttggggtggggaggcgatgcgtcgctttttctcggtcaatagtgatatatttttccggaccttgtgcttggtcgctgttactaccttctttacttctacaggtgcgagacaaggggatgtgatattggccgtaaataccttgttgatgcagttgtttaccttgttctcttatataatggatggtttcgcttatgcgggagaggcattagccggccggtttattggagctaaaaacaatgtggggttacgtaaatgcattcgtttattgtttctatggggaatcggcctctctttatcattcacgattctttatgcgtttttagggagggattttctgggactgttgacgaacgatacctcggtcattaaggcttccggggattatttctattgggtattggcgatccctttatgtggattctccgctttcctttgggacggtatctttatcggggccacggctacacgccagatgctttgctcgatgcttgtggcctcggctactttctttattatttattacctgttttatcgatcgatgggaaatcatgcgttatggatggctttccttggatatctctccttgcgaggtggtatgcaatggatactttggcgatataggaaaattacaatgcccattataagcaactgacaatgcccatcgtaagcggcttataatgcccagtataaggagcttataatgcccattgtaataaacaaagaaagcgagacttctatctggttgataatcaagtctcgccttctttgttatgtggaatgatagttgtttatcgttgtctgtatgagatcaattcttctgggttgaatcgtccgatataaccctgatgtttctcaatctcagcctctacgtaattggtgtaaacaaccgcggacttagcgaacagctccggtgctttcgtcgcgtcttggatcaatagatgagccatgatgatatcagcggccatctccatcaagcggcgagccacgaaatcgagtaattcctgatcttgagactcttttactttcgccatgctagcctcgaacttattggccatctctactaaacgagccttcagcggttccatctcggcggagcaagggatcgcctcgaattcacggatggtagccaggtaagacccgtttgtcacgtaacgtatggccgctacggtctgcaattgcgtcgtaccttcatagatggaggtgatacgggcatcgcggtagatacgttggcaagcatactccatcataaaaccggaacctccgtgtatttggatgcaatcataggcattctggttggcgtattcggaattcataccttttgccaacggggtgaaagaatccgccaatttggcgtattgcttctgttccttacgctcttccggagtcagtttgcgctcacgggcgatgtcgtccagtgccttgtaaatatccacgtaacgagcggtttggtataacaacgcacgtccggcatccagcttcgctttcatgatggcgagcatgtcgtaaacagcagggaagtcgatgattgccttaccgaactgcttgcggtctttggcgtaggctaatccttcgttgtaagcggcttggctgaggcctaccgattgtgcggcgatacctaggcgcgcgccgttcatcaaggccatcacgtatttgatcaagcccagtttgcgatcgccacaaagctctgctttcgcgttcttgtaaactaactcgcaagtaggagagccgtggattcccaatttattctcgatacggcgtacgtttacgccaccttcccgtttgtcgtagataaacatggacaaaccacgtccatccttggtaccttcctcggaacgggccaatacgaggtgaagatccgcgtcgccattcgtgatgaatcgttttacgccgttcaatcgccagcaattctctttctcatcgaaggcagcctttagcatcacggattgcaggtcggagccagcgtccggctcggtcaggtccatagacatggtttctcccgcgcagatacgtgggatgaaacggctgtgctgatcctcgttgccgaactcatataaggtttcgatacaatcctgtaatgaccagatattaccgaagccggcgtcagccgccgctacgatctccgcgcacatggtgtacggcgtgatcgggaagttcaagccaccgaaacggcgaggcatcgtcataccgttcaaaccggcttttaccatcgcgtcgaggttctgcttcgtgccggaagcatattccacacggccattcgcgcagtgaggaccttcggcatctacgccttccgcgttaggggcgatgatctctccggtgatctctccggtaatctccagcaccttatcgtacgagtctatcgcatcggcataatcttgcggcgcgtagtcgaactcttccttgtctctgtactcgcgttccttcagctcgcaaatacgttccatcatcggattgttcaagtgatacttgagttccggtatgtctgtataataattagccatctttacttactgttctttttgtaatacttaatcatcttaggaatcacctcttctaccgtaccattgattacgtaatcggcgatcgtgttgatcggggcattctcatcattattgatcgaaatgatgataccggcgtcttgcatgccggcgatatgttggatctgcccggagataccgcaagcgatatacaatttcggacgcaccgtgacaccggtctgaccgatctgacggtcgtggtcgcagaaaccggcatcgacagccgcacggctggcgcctacctcggcgtgaagctctttcgctaaatcgaacaataaattaaagttctccttggagcctacgccataacctccggccactacgatcggagcgcctttcaggttgtgcttcgctttctctacatgacggtcgatcaccttcaccacatagtctgtctcggggacatacttcgctacgtcgtggcggatcacttcacctttatagttctcgtcaaggacttcctttttcatcacgccctcacgaacggtcgccatttgcgggcggtgttccgggttgatgatcgtggctacgatgttaccaccgaacgccggacggatctgatataataagttctcataggtaatacccgcttttttatcctcgtgcgagccgatctccaaagaggtacaatcggccgtcaagccgcttgtcaaggccgaggatacacgaggacccaagtcgcgaccgatcaccgtagcgcccattaagcagatctgcggtttctcctccttgaacaaattaatcaagatggaagaatgaggaagtgatgtatacgggaataaacccggagcgtcgaacacatgaaccttgtcgacgccaaaaggcaatacttgtttctctacaccctcaaggccggagccggcaacaatcgcttccagttggcagcctaattgattggctagcttacgacctttggtcagaagctcaagacttacatcggcaacgctcgtgccttctgtctcacaatatacaaatacgttgttcataatcttatccgatggtgtggttagctaacagttcgacaatcaaatcctctacatcttggtcggaaccgtagatcgtcttgctttccttggcctggaagacgatgttctggatcgcttttacctttgtcggcgaaccgctaaggccgcattgaaccaagtctccattcacgtcggctacgctccattcctggatatccagatacgggcgggtctcgtacaattccgggtagcgaacggtcggttctccatcttggtgacaggcgggttgcgtgttccgctcttgcttgcccatggcgtatttgtacttctgtaccaacttcgcattacgaggacggcagggagcggcggaaccattcacggtgattacgatcggaagcggaccttccacagtctcgacacctccgtcgatatgacgttttacggtgatacgtccggcctctttatctacgttcaggatttcctcggcatacgtgatctgggtcagtcccaatttctcggcgacttgcggacctacctgtgccgtatcgccgtcgatcgcttggcgaccaccgatgataatatcataatcgttgattttcttgatagccgtggcaagcgcataggatgtggctagcgtgtcggctccggcaaacgcacggtcggtcaacaaaaaaccgccgtcagcaccacgatacaaaccctcgcggatgatttcggcggcacgtcccgggcccatcgtcagcagcgtaactgtcgtcccggggtaagcgtctttcaagcgtaacgcttgttccaacgcgttcaggtcttccgggttaaagatcgcaggcaaggcggcgcgattgatcgtaccgtccgctttcatggcgtcctttcccacgtttcgtgtatccgggacctgtttcgctaaaacaataattcttaaactcatattatattaggaatattagatttttatgttgatataatacttctacattcttgttaatctcgaggtgcaaaagtaatcaaacattctttataacaaagaactttagtcgggaaattgcacacttcgtatctgtttgagcatgtattgcctgttgattactcgtagcgatgattggttctcgatctctttacgacttgtccgtacacgatcaacgctatagcggagaccaaggctatcgcaccgaagtaataccagatgtaatgagcgtttgcgcttgccgcgagccattcctcgtgagaggcgaacagcgtgggttccggacagtatttacttaaaaggaatccagataatccgaatccgaagatagaggataagaaagagtgcaaatggctgaatccaagatagagaccttcttctcctttgggtgcttgcaaggagaaatactcgagaaagcgaggagagatgaacgtctccgccagcccttggaagacgatacccaccaccatcatgaaggctacgggatgcatccctaagatcaaggaattagtatccagcatattgccggatgccatgcagagggcggataccggcatgataaacatccctaccgtcatggaggtaagcgctgtccgtttccgcatcatccgcgtgaccagattgactgtcagaactacgactaatggatttacgttggcgtaccaagaaggagaggccccctcgccggccaaacgaagcacgtatttaggcatcgtggcatacagctggtgctgaaccatccaaaagcctgtaatgatgaggatcaagatcaataaccgtccgttactacaaaccttgatcagggcgttccagatttgcccgaacgtcttgccctcgcccgaatgctgagtgcttttgtagaagaaccagatcgctatcaatgcgaggaaggtcatgctcgccgagaaatagttcaaggtaatcaatccctcgttgcccaacgcctcgcgaagcggcttcacgatggtctttccggagaaagccccgatatttaccattgcgtagaagatagagaaacccttcgcccgggtttccggcgtagtctctttagcgactgtaccggagataacgctcttgatgaaagccccgccgcatacgatcaaggccatgatagggataatgccgtactgaagattgctctccagcaatcccgtaaaggtagtcgtcgtgctgtattcaacaagtccggcggattgaagccaagtagggtaaactgccagtcctagataaccacaagttaacaaagtgaaagccagtagcatcgagttgcggaaaccgatcttatcggccaacgctccggcaaacgtgggcagcagatacagacaagcggaaaagataccggcgatgctggcagcctgaatgtcgttaaagcctaagatgcggctaagataaagggtgataacgataaatacgccataataagcggctcgctcgaacaactcgacggtgttcgctacccagaatgctttactgaacttgattttctcttgtttcttagttgtcatgatatttttattagtaagatagattagatggataagtaaaagaggaggcgcaggtgagaaaatgaagagctgcgcctcctcgtctttgttttatcgtatagtaattacgaattagggctttacggtatacggttggtggatcgccttatcgaaagctttccaatgctcatccgtcatgttgcccggcgtaaacaacgccacgccagccgctccgttttccatggagcctcttacggcctcctcgatctcggacgggatcagtccgtggccttccgggtccttgatattcgccttgttctgccaatcctcgcagatgaacaaaccgctataaaccggcttcttgccttgcacggaggctacttcctctttcacgatcggagccagccaagaagcgtcctccagatagaaatcgttataattcatcgggaagaaagcgtcgatattccatttattccattcttgacgaaccatccatttagcgtgagagtccggccccgggaatacggcggcgctcactttcttgcctttgccgtgaacctcgtcggcgatgcggtttaccaatttcgtgatcaagtcgcaacggaactgcgcccattctgcgcatttggaaggatcctctacggatttgatgtcgataccggtagcggccttgaaatcggccacgcatttgtcacagtaacaatagtccgccgtaggatattcctcgtccatcaccaaaccgtatttttcccaaagtccgcgggctaggatgacatccacgtaacggatataatccagatggatataatccacctccgggatatcggctaccttgccatacagattcagcaagaactccgccgtaccttcttggttcgggcacaggcatttgtaataaggcacatacgcctgtacggaataggccgactcgcctttccggttcacggcgtagagggtggagtccaatccatgttgcaacatggcgggaatccatgcgtgatattccatgccattggcatgggccgctttggcggcacgctgaattttctccgtgtcatggccggcgttgtagcacatcccgtctactccgtgggcatgccatttactaaagtccgcctgtaaggtttgctcggtggtattcccaccttcgccttgccatgcgtagaccttgactgttttctcgggagccttgacgcaagccgtcagagcgacggccgccaaagcgataaagagcttcttcatatctcgcaagcgcataaagtcggtattaagttacgatcgccataagcgttatctacacgggctacgttaatccaaaacttgctgtcgtgcaaccattccagcgggaaggcagccttcgtgcggggatacgcgtgtttccactcgtcggcggtcacctcgtattctggatgcggggcgttcttcaagacgttgtcctccttcgaagccttgccttcctccacctccttgatctcgttccagatacattccattacctctacgaaacgatccagctcggccttgctctcgctctcggtcggctctaccatcaaggtgccgtgtaccgggaaagatagggtaggagcgtggtagccgaagtccatcaaacgcttggcgatatcgccctcgtcgatgcccgaacgctcttttaccgtgcggcattccaagatcaactcatgacctacacggcctgtcgctccggtataaacgatgccgtacgtatccttgaacttagcggccaagtaattggcgttcaagatggccgtcttcgtcactgtctcaagaccttccgtacccagcaagcggatgtaagcgtacgtgatcggcaggataccggcgctaccataaggagccgcggataccgtattcaagtcgctgccccaaagcaccggatgctgcggcaagaacggaaccagatgctcggccacgcagatcgggcctacgccgggaccaccacctccgtgaggagaagagaaggtcttatgcaggttcaagtgacatacatcggcgccgatcgtacccggatttgtcaatcctacctgcgcgttcatgttggcgccatccatataaagctgtcctccgcaagcgtgaacgatgtcgcacatctccttgatgtccacctcgaagataccatgcgtggacggataggtaatcatgctggcagccagacgctccttgttctcctcggctttcgcgcggaaatcttccagatcgatattaccattctcgtcgcatttaacggttacggtcttatatccgcattggatagcgctggccgggttggttccgtgggcggaagccggaagcaaaacgatatcacgatggccttggccgatgctttcctgataagcacggatcacacgaagacccgtgtactcgccggcggcgccggagttcggttgcaacgtacagcccttgaagcctgtgatcgtgcataagtaagaagacaggttctcgatcagctccgtatagccctccacttgctcctccggagcgtacgggtggatattcatgaattccgcacggctaagcggcaacatcgtagaagccgggttcagcttcatcgtgcaagatcccagcgagatcatggattgagccaaggaaacatcctttcgtcccaaacgggtgatgtaacgcatcaactcggtctccgtatgatatttcttgaatacgtcttgctgcaagaaattggaggtacgggcgaatttagcgtcgaaataagtctgggcggggatagactcgtccagcatatagtctttacctgcggctccggcgaagatgtatagtaatacgcctatgtccgtaggcaatgttgtctcgtctatgctgacgcccacttgtccggcctcgaaataacgcaagttcaccttgcactccaaggcgatctcacgcagcgcgttcaccgacacgtgtgaaggaagctgtatcttcaaggtatcgaaataatccttgtttaattgcgtatatcccagtttctccaactccttggccaagaatccggccgtggaatgaatccgtccggcgatgttacgcaacccctccgctccatgatatacggcgtagaagccggccatggtagccaacaacgcctgagccgtacagatattggacgtagccttctcacgtttgatatgttgctcgcgggtctgcaaggccaagcgataagccggatggccgtaagcgtccttggagataccgatgatacgtcccgggatcgtacgtttataatcgtccttcgtagcgaagaaagcggcggaaggacccccgtagaacatcgggataccgaagcgctggctgctaccgaatacgacatccgctccccattctcccggaggagtcagcaataccaagctcatcaagtcggcggctacgcctaccttggctccggcggcgcccgcacgggctacgaattccttatagtcctcgatcgaaccatccgcattcgggaactgtacgatggcggcgaacacatccggcgtgaactcgaatttcttataatcgcccactaccacctggatgccctgcgggaccatgcgggtgtggatgacggccagcgtagaggcgaacacattctcgtcgatgaataccgtattcgcttccgctttcacctgcgcacggctacgtgaaccatggaacatggtaaccgcctcggctgccgctgtcgcctcgtcgagtagcgagcagtttgtcaaaggtaatcctgtcaattcactgataacagtctggaagttcagcaacgcctccaagcgtccttgggatacttccgcctgatacggagtataggaggtgtaccaaactgggttctcgaatacgttacgttggatcggggccgggcaaaccgtgtcgtaccaacccataccgatataagaggtgaatacctcgttcttggaggccagctcggcgatatgctcggcgaactcacgttccgtcatggcctccgggaggttcaacggctctttcaaacggatgttggccggaatggtctgatcgatcaactcgtccaaagacttcacgccaatcgtctccaacatagcgggaatatcttccgctgagatgcccacgtggcggtttacaaacttatttgtgtccataattctagtattttataaataaggattatttaatttctcatcaatgattcgtgtctcggggccatggccggggtataccacggtctcgtccggcaacgacagtaatttgtccttgatagcggcaagcagtatatcttggttgcctccccataaatcggtacggccgatgcttccggcgaacaaggaatccccgacgatcacgaaaccgttcttcttgttatagaaagccacgcctccgggcgaatgaccgggaacgctcaataccgccagctcggatttcccgaactttatgatttccccgtttaccagatatttccctaccgggatgcttttcgccttcatcggcaggccgaatgccttggcttgctcctcgggagagggaaggccctccacgtccgctttatgggcttccgggctcaatccgtaggtgtcatggatgaattcgttaccgaatatgtgatccagatggaggtgcgtacaaaggtaacgtttcagcgtcagcccgttctgggcgataaagtcgcttacttctttttgttcctctttgcgcaggcagccgcaatcgataaggaccgcctccttggtatcatcgtatagcaaatacgtattctcggagaaatagtttacttcgaaagattttatcgtaatcataagggtacgtacactacttttttagtttcaaaaaactcttctttaaaatggtctttcagatccatgctgatcgcttggttccggaaaggcaatatctcgtgcgccagctctccacctttcaggcaaatcaatccgttgggcaatgcgttgatctgttctttctttatattcttgcggacgatctttaccagatccgccagaggcatcacggcacggcttaccacgaaatcgaaaagctgcttttcctcctcgccccggcaatggcggaaggatacgttctccagcccgatcgcctcggccacggcttgtcccaccttgatttttttcccgatgctgtctaccagatggaaatgggtctccgggaataagatcgccaaggggatgccgggaaaaccgcctcccgtacccagatccatcaccgaggaacccggcttgaaacgcagcatatcggtgatacccagcgagtgaagcacgtgatgcggatataggttctcgatatccttccgtgagatcacgttgatcttggcgttccaatccgtatataggtcatatagggcggcgtattgctctttttgccggtcggtgagatcggggaaataagatgtgagaattgagaattgagaattgagaattgaaaatttctctgtattttgttccataggacatctgtttataggtttatctatcattaattttcaattctcaattttcaattaactgacttatcgggctgtcatcccgcagcaaatagcggatttccttgtaagggagatggacgttcgtgacgcctaccacgtatgccgctatctcatattcgttgaaagaataggtgatacccgtctcgtctacgaggaagttcccgttcgggaagatctcgtccacgctaaagaaaccgatattttccagttccttggcgtcggatacgttgttttgcttggcgatctgatctaccaatattcgcgccagattgtcttgatagttgtccacgaatatctcctcctcggtgatcggcttaccggtcttgaggttcactacatggttattgtaggaatgtgcgccatgcgctccgcccgtatagttctcgaagcttaccgtatagctgatgatatcgtcttggttgaaggcgatatcatccgacgacatctcatagtaagagaaccaagagcccaccggtgtctcgtcggatttcgccacctcagccttgtaatcctcttccagatccttataagcggccagatagtcgtcggtatatttccgtaccgcctcctcgggggataattgctcataattctcgccgaaataagaggagacgaactgtctctgtagattcttaagaacctctttatccgaatatttccggggataaacgaacttgatctctagattgcaattgggattatccggattatctaacaaatggtaagtcttttccacgctgatagaatcaaacgtgatactgttttcagaagccttcttcgttccggtatcgcaacccgtggctaagatacctatcaaaagaagcgccaacatgctttcgcgtaaatgcgttctcatcggactacagatttaatttatttgtacgcgaatgtacgttattaaattgtataatcaaattgcacgatgaagtttaataagaggacaatctttcctcggtggttttcgggttgagttgtctatttgtccgatactttccgggtgttctcttgcgtgagaagaatagttcccattttatatcacctaggggcgtacccagccttatccttcataagatgcaaggccaccaaactctgtcgttatattaatgtcataatacaaatacacttttgcgcctgcatcaggttttcttgagcttgtactttcttggtcataataaacctctatttcggcttgaggatcttctggtttttccccttcatcgataatgtcattttcactacaaccaataaaaatgaccatgaaaaatatgaataaagaagttctcatgtttctgaatcagttttaattagttaacaactaaaataggattgccctaaatgtacaattagtttttatcataccattatagtttgaaggaaattatgggtaatgatgataaaatttaactatagcctattggcacaagtctaccatcaataggatgtgaacgcattaaaaaggttaaacaatagtgagctacctatattctcacgaacgagatagctcttttctttatttaactcccgtgccttgttgctggtcacgctgtacggctgtacggacagcagcctctaccaacgcatggcgcacgaggtggttgacccgtggctggacgagccttctcccaagaaaagtaagtctgtgttgatacgtcgtctacgtgattacgacggttggctgaaacataatgaataatgaataattcaaaattcatacatcataaatcataattcaagacatgtcttcccttccttcgggcatccgtttgatgaacctgttgcgtgaccatttgacagagatcatggatcgtgagcgtgcgaacctgaactcaatacacctgtattgtacgggatcttactgggtgtcgttcgagcgttctgcctatcagttgcgtcgtgtgtttccggatagcgagactacgccgctgcgcctgttcgcttatccgttcccgatcgtgatggtgtccgttacggatcgctcactccgtttgtacgcccgtaaacatatcttgaggagggacgagacggattacaagctattgaccgtccccgggcttcccatggcggattaccatgtatggcacgctggcgaggtggaaggcttgccccagctgacatgaactccaaatatgaagcgctggaaaagtaataaactcaattatggtataatgattttgattgatggttggcaattagcatgaaatttcgtatatttactctagaggaaaaataattgtcataaattaatgaaagcggacgtgctaaattcgataaaagagaccttacgtaaggtgatcttgatttccatctgaaaggcactcataaggaaatgccgtccgatgagatgggcaatggggcgatagacacccatgagcaatcttaggtgacttgcgccactaacctaagatattttaccaacgtacctaagatacatggtggatgaacctaggatatttttttagtcaaaacaaatgctttgggtctgttacggatctgaagtgactacttatatacaataatcattatgtcagaggaaatcaaaattgctgtagctggaaccggttatgtcgggttgagtattgctacgctgttggcacagcatcatccggtcactgcggttgacgttataccggagaaggtggagacgctaaaccggaagcaatctcctattcaggatgagtatatcgaaaaatacctaaaggagaaggagttgaacttgacggctacgcttgatggagcgtccgcttatcgtgatgccgatttcatcgttattgcggctcctaccaattatgatccggtgaagaactattttgatacgcaccatattgaggatgtgatcgatctggtattgagtgttaatccaagggcggtgatggtgatcaagtcgaccattccggtcggatattgccggagtctttatctgagatacgcccaaaagggtattgagcgactcaatctgctgttttctccggagtttttgcgtgagagcaaggcgctttatgacaatctttatcccagccgtataatcgttggttatcccaaattgctaagcgatgagcaattcaatgcggagaatgaggcgatcgagaggattgcggatattccgggtttggagaaggctgcccacacgttcgccgccctgcttcaagaaggtgccattaaacaggatattccggcgctattcatgggaatgaaggaggccgaggccgtgaagttgtttgctaatacctatctggctttgcgtgtaagttattttaacgagttggacacctatgcagaagtgaaaggtttggattcgagtgccatcatcaagggcgtggggctggatcctcgtattggcacgcattataacaaccccagctttggttatgggggctactgtctgccgaaggacaccaagcagttgctcgccaattatcaggatgttccccagaatatgatgaccgcgatcgtggagagcaatcatacccgtaaggatttcattgcggaccaggtgttgcgcaaggccggctactacgattatagcgagaggaacagtttccagtgctccgaagagcgagaatgcgtcgtgggtgtataccgtttgacgatgaaatcgaacagtgacaattttcgccagtcctctattcaaggcgtgatgaaacgtatcaaggcgaaaggggccaaggtgatcgtctatgagcctgcattggaagacgggagttctttcttcggcagtgccgtggtgaatgatttcgcccgtttcaaggagatgagccacgccatcatagccaatcgttatgatgattgtctggacgatgtgttgggaaaggtctatacgagggatatcttcggtagggattgaatctttagatgatggctttacaagagaggctgggaaggaataagaccatactggctaatttttcctatctgagtttgctgcaggtattcgctattctatttccattgcttacctatccttacttgcttcgggttataggcttggaattgtatggcgtgatcatattcgctcaatctataataaactatgtatcgctggtgatcaacttcgggttcaatatgtccggagcgaggaacgtggcgatttacaagcaggatagggcaagattatcccggatcgtcacatccatttattggtgtaagttcattttatggcttgtttgcctagtcctgtatttatcggtcatcagtatggttccgttctttgaggatcattattgggtgtatgtcctctctttccttttgacattcaacgagcttctgttacctatctggttctttcaggggattgagaaaatgaaatatatcacattcgtgaacctatctgcccgcctgttgttcgtggttgctatattcttgtttgtccatcggcaagaggattatttgctggtccccttgttaaacgggatcggggctatactggcgggttgtctctctttatatatcgtgttggaaaaagagagagtaaggttttccttgatgccggtaagagaattgcgatcggcctataaggagagcttgcccttatttgtttcgatcctgtccacacagatttatgtgaacgttaataaattggtgatcggttcttttctggggatgttggaggtttccatttatgatatggcggataaggtgcttcttttgatgaaactcccagcctccatgatagcgcaagccgttttcccgaagatctcccgtgaacagaatattcgttttatcaatcatgtgatgttcttgtcggtagggatcgctttacttttctacattagtatgttcttcggtagtgactggttggtgtatcttctcgccggagaacacatagaagaggcttctgtcattatgcgattgctgggaatctctgcgatcttgacatctatcaatggtttccttggaggaaatcgtctggtcccgctaggctattcgtccgtgtatatgagagtgatggttggaaattgtctgttttttctgacggctatgggcttgttgtggctgacaggaagcataactatgtatacggttacggtaatggccgtaggggtggaagtgttttgctttgtgtcgttagtttataggaactggcgattagggttgtagggtttaataaaatagtaatacttatttaggatatatatctaaataaagtgttataacagagatttattaagaatatgttgtttttcattatagcgttttttctctttttttatgtgtatataaaaagaatgataagggatagcttttcgaaaaagatcatattgtctttttggactatatggtttatatctttggttatatctactttcaatccttatggactttatccggtatctgatgaagtatatgtaatcatgttactaaatgtttctgctattatattaggtttttcttctgtaaaagttaataaaaatatatgtttagacaaaaaggtatatttatattctcgttctttgaatcggtttatttatagtaaaaaatatttaataatactttttgtgtctatcattttattaggaagtctcctcgtaaaatattggaatgtagtattgtctatgaatcttgtaggagttgatgcttttgaaatactaaatgatgatctttatagcatagattttgttttttatacattctttgctcctccattgttttattgctcaaatgctatattagcttattgtttgttttttaagcgagtgtataatcggatgattataatatatatatatatattggattatgctcttataggtggaggtagaacgaactttttagttctattgtttgctgtgttttttgtttttatgataactggaattaaacttaaatttaaatatgtattttcgttatgtgtgtttagtttgtttatatatgttgtgattagttatttttctgcttttaggtttgacatgcaggagttttcattggatactattagagaaggagcttctatttttaatgaaaattttgttacttacttggttttacctcatcgtttgtttgattatgcgttacaaaatgattatttatctcaaattggtggttatcattatggattagttagttttgatggaattaatcggtatttaagattgtttcttcgtttattttctatagatatacctgctatttatgaaaagactacagctatgtttcaggatacaagaatatttataggtggtgatagtttttctaattatgcttatacaaatgctatttatcattatttggattttggaatagtcggtgtttttgttattcctttttccttttctttatttattagatgggtcataataaagttttataaaacagcatcagtctcttctttctgtttgttgttctatttgtattttgttttaatgaattgtttttttacttggcatcttaataaattttattcattgggatttatcttgtttatggtatgtgtgatgtgttatgataagaatgtattatatcgaaggattaatattttgataaagaaaaatatgtgattatagtatttatatactttttattaaatatatatgttatattttaatgaagcatgatgggtatttagattaaataaatatcagaaatttagtgtttatagtttgaaagaccaatatatgaatatactttttattgtgaatgatgctggagtttatggtgcaaacctttctcttgcgaatttgattaagtctttggatttaaaaaatagtttggtattgattccttcaaaagggccattgttgtttttattagataagatgaatatagcatatttagttataccatttagatttaatagtgcagtatatgatggatgtgtttcttcgtgtttgttgtatattgttaggtttttttattataaggtgctcaataagtattcttattatagaatattgaaaattgtagatgatgaaaaaatagatattattcatacaaatgataatcgaactagtataggtttagaggtggcaagtcgtaaatcgattaagcatgttttacatataagagagttcttggatttggattttaatatgaggccatttaagccgtttaagaaattatgtaaagattttaatgagtcagattctattatctgtgtgtcggaggccgtaaaagagcattttcatattcaaggagcgaaagcaagagttatttataatgccgtagactctgttcgtaatcttcataatataagagaaaagaaggaatcttattttctgttttgcgggagtttgagcgagaaaaagggtgtttttgacgctatatattctttttcaaagatgttgaaagacagggatcttcaattgtacatcgcaggtacgggaccggctcatattgttaagaagattcaaactgttattcaaaaggaaaatcttcagaataaagtgtttttgttagggtatcgaaatgattcaaaagaacttatgcgtaaagcgatcgcattgctaatgtgctcaaaatacgaggcatttggacgggtaactgctgaggcaatgttaaatgactgtttggttataggtaggaattcaggtggtactccggaattgatagaacatggaaaaactggattcttgtttaataccaatgatgagttaaccgtattgatggaaaaggtcttgagtatggatacaactgatattcgggatagggcgaaagagaaggccataaactcttttacggaagaggtatatgcggagcaattgaaactggtttatgattccttgagatgataaagacgtattctttcgacatttttgatacctgtctcgtccggaagtgtggatcttctgataatatctttcgtatatgggctgatcgtgctttgggggaggttgataggtcttatctgaaagatttgatcaattcccgtttgagcgcggagaaaacggcgcggagaaattccggcaaggaggatgtctccttggatgatatataccgtaatcttagcttggaatctttcccgaatttgtcgataccagctcttaagcggttggaactggaggtggagcgtgagaatttatctccggtgcggcaagtcttggatttgatacgggactaccggaaaagaggaaagcggatattgttcatatcggatatgtatttgccttccgatttcctgaggttccaattgcggaggtttggcttctgggaagaggaggatcgtatatatgtatccggagagatcggcttaacaaagcattccgggaatttattccggtatattcaaagggaagagaagatatcgagatgctcatggaagcatgtaggggataatacatatagcgattattacgtgcctaagtctatgcttatacggtcaaggaggatttatcttccttataccccttcagagaatctgtggcagaatgatatgcgatttccccatgggaaattcctgccttcttatttgtcgggattggcccgggcttatcgattgtcccttcccggttcggatcgtttggattttttcgtggacgtgttgttggttccttacttcttgtttgtgtataatgtcttgtgtgtcgccaggaatagaggcgttgacaatctgttttttctggcgagggatagcttcgtctggtatcggatggcgttgaggctgcgccctttgtttccgggaatggattttcattatctctatatatcgagaaaggttgttttcgtttcatgtttgtatgacttgtcggactatgagtttgagctggtcttttccgatacgataggctatactcctcggcagttgctttcctcgttggccttggaggaggacgagatgctgcaggtcttttgtgtggacgagctggatgagcccttggacttgggaaagcgagtgcggttttatgacaggataaggtcttcttccttggccatgactttattggagaagtccggggaggctaggcgcctgctattatcctatttgcggcaggaggggttcttgggcagcgaaaagccggggatcgtggatatcggctggaagggcaatacgaaccgtgtgcttaactatatattgcgtcgggaggaagacacgaacgcttacttgtcgtttttcctgggggtgaaagagacccgccatccgatcgcgagcataggggattatgaggcgggatattatttcgaggattttcttgatgagccggagtatgcctataacttgtttgccttggtgtatgtgctggagaattatttctcggcctcggacgataccacgctgttgaggtatcgagaggagggcgggacgatatatcccgaattttcgcccggtaccatatccgccgcttccaaggagaaaaatcaatatatcttacgcttgacggagggtttcttggatcttataatggagtccggtttattgcgatacgatccctcctctctcttcggggacgtaggggtgcctaccctgctccgtttggcatcccgcccgtcgatggcggagctgcgggtcttgagggagcttaccttcaatgatatttatgtaggtgacaggaagatcgttctgaagatgtatccatggaccatctgcgactatgtgctcaagaagctgaagaacaggaaaaacgatgagtatatattcacatggtttgatgcctcgattatttatacctatggattcttgtccggacctatattgaagttaaagaaaaatatattatcagattcattgattcatttattaatcaaaaaagtaatgacattatggaaataaaagaattcattcaaaatttcgccgatcagttcgatgatactgagacaagcgtgtttactccggaaacggagttcaaggaattggaggaatggtcgtcgttgacggccttgtccgtgatcgccatgatagacgaggagtatgacgtgaagatcaagggtgacgacgtgcgtaattcgcaaacgatcaatgatctttacgaaatcgttaaatcccgtctctgatggcttttctggaatttcggaatgtacggatctccggcatctcagccggagttccgagacatgtggagtacaataaggattatccctattttgaggaaggtgaggcggagaaatacatcgcctccacctccgttagggagaggcgtatcgctgatcccggggtttgctcctctgatctttgctattcggccgcggaacgtcttatagaagacctaggttgggataaatcagagatcgaatgtttgttgtttgtctctcaaacagcggattatatcctgccggctacggcttgcgtcttgcaggaacgtttagggttgcccgagagctgttatgccatggatatatccttggggtgctctggctgggtttatggcctgagcgtgatcacctccctgctgtcctccgggcagataaagaagggcttgctcctttccggggagatctgccatttgcagtcctcaccgttggataagagcgcctatcccttgttcggggatgccggaaccgccacggctttagagtatcaagaaggatatgagcctgtccgctttcatttttctacggatggaagcgggtatgaggctatcattatccgtgacggtggctataggcatccttttgataaccaatcattggatgtttatacgacttcggaaggtttacgaaggacacgtttgaacacggagatggatggcatgagcgttttctcgttcggtataacgagggcccctcagagtttcaacctgttgatggatcgcttctcgttggatcgggagtctttggattatttcgtgatgcaccaagctaattatttcatgaataataagatccggaagaaattgaagcttccggaggagaaggtgccttactccatgcctctttttggcaatacgagcagtgcctccataccgttgactttggtgacggcctgtgcattgagagcacggaggagtaagatcgcggtttgtggattcggggttggcctgtcttggggaaccggttatttcgagttggatgagaatgtagtgataagtgacttggtagaaatataaataattatgagttataatccatattcattggagggaaagacgatcttggtgacaggagcgtcttcaggtatcggaaaggctacggccatcgagtgttccagattaggggctcgggtcgtgattacgggacgggatatgtcccgtttagaggagacattctccttactggaagggagggagcattcattattaaaagcggatctttcttctgaggatggaattagaagcttggtcaaagatattccagagatagatgggttggtcaatgcggctggaatggttaaaaccataccttttccttttatctctaaacgtgatatagaggaaatctttgatataaatttctatgcccctactttattgtctaaatacttgataaaggcaaaaaggatgccgaaaggcgcgtctatagtttttctttcgtcgatagatggtccggtcacggcgcatcatgcgaattcgatttacgcggcctcgaaaggtgctgtatctgcgatggcgaaaagcatggcgatggatttggtctcaaagaaaattcgggtgaactgtgttttaccgggtatgacggagacgccgttgattcatggggaggcattcacggaagatgatttagaaaaggataagagtcaatatccgttgaaaagatatggccgtccggaagagatagcgtgggccatcatttatttcttgtcggatgcaagcggtttcaccacgggcgccagccttgttgtcgatggcggatttacggttttataggctatggcgatactgaaatatatagatgtggggattcattcggtctcagcttgtgtcccaaaaaaggttgtgcggaattccgaactggataatttgattcccaaggaggatttggataagaccatccattccatcggtattcgtgagaggaggatagcggagcgggatgtctgttcctccgatctttgcggcaaggccgcggagcggttgctctcggagcgtggcatcgaccgtgactctatcggtgctctgatctttatctcccagaccccggattaccgccaaccgtccacggcgccttccttgcaggatcgtttgggcttgccaaaaacggtgatggcgtttgatatcaacatggcctgttccggatatgtgtatggactgtccatcgcttattccttggcctcgcaggatgggatagggcgtgtccttttgctggtgggagagaccatgtccaagaccgtatcggatcatgacaaggtgacgacaccgttgttcggcgacgccggaaccgccacgttgatagagaaaggagatgggtatggcccctcctgtttcgtgcttcattctgatgggggtggctcggatatgctccgcgtgccgtacgggggataccggaatcctagtagcgcagagggatttgagcgaaaagtggatgaggaggggaatatccttggcggtgagcagttgcacatgcgtggaatggatgtcttcaattttggtttgcgggttgttccctcgggcataaaggagatattgaaaatcttggatatgaggatcgaagatgtggatatgatccatttccaccaggccaaccgtttcatgacggatttcttcgccaagaaattgaggttcccgttggatagggtgccgtatagcttggagtattttggcaataccagtgccgcctccattcccttgaacatggtccataccatgtatgacggcagtttccctagacggcggcatgtgcttatggccggttttggggcgggcttggcttggggaacggcttatctttccttggaaaatctaagaatctcaaagctgatagaatattaagatgagatattatatatttcggaacaacacgcttgagcctttgttcgggaatctggatgcttgttactccggctatggggatatctcctcgctggaagagggggcggatcgctatatatggttctaccaggttcctttcgggtttgataggtgccgtgtggcggaggaggtgttgtcctatatcgataagttgaggtgggtaatagaaaagataccggcacataagagcgtgctggtcttctccttggttgatctttgtccgtttcaatgggccggttcagaatgggaggtacaggagagcatagagacctataacaagtatctacgctcgctcgcctcggagaggagtaatgtccggtatgtggatctgccggatttcactcgccgttattcttccagccaattatttgactggcgtttctattttatttcccaaatgggcattaaccctaagctggcttccgacttttcttgctggtttgaggatcgtttgagggagataagcctctgccggaagaagtgtctggtattggatctggacaatacgctttgggggggggtcctcggggaggacggtatagatggaataaagataggaggtgattatccgggcaaggcgttcctgtattttcaggaaggcttgttggaactggccaagagaggtgtcatactgacgatctgtagcaagaacaacgagcgggacgtgttggatttgtgggagaagaatcctttcgtgttgttacggaaggaacatttctcggcttggcgtattaattggcggaacaaggcggataacataagggagctttcggaggagctgaacataggtctggacagtctcgtcttcgtggatgataacccgacggagcgtgagttggtccgccaaatgcttccgatggtggaggttcccgagtttccaaaacagccttatatgctacccgatttcttgatctccttgtcggatcgttatttccgtgtctattcggtgacggaggaggatcggcggaagaccgagcagtacaaggcgaatgcgagccgtacacaggagcgaaagaaatttgtggatttcgatcagtatctacagagtctggagatcgagatgaggattgaaccgatgagctcgttcaatgtttcccgtatcgcccagatgacccagaagacaaaccagttcaacttgacgacccgtaggtattcggagatggatctcatgggatttttttccgggggctggttgatctattgcctttccgtcaaggatcgtttcggggataatgggataaccggagcggtcttgttgagacctatcgatgggggttatgaaattgatagtttcttgctcagttgccggattttaggcaagcggatagaagaggcgttcttgtccggtattcttaacatgttgaggaatagtagtgttaagctcgtaaaagcgtcttatgttccgacatccaagaatatgcaagtctcaggcttctatgagcaagccgatttcattttggatggccatgataaggatggaagcaagttctaccatctagaaatgggtgcggagataaaaatcccatcttattataaaataacatattgatagtatggaagaaaagatattgtgcgtattaaagaacgtgttaggattggagagtgcgacaaaagcgttatcccaacagaattgtgataaatgggattccttgcgtcatttgaatttgatcgttgagttggaatccgagtttggtgtcgagttcgatccggaggagatctccgggatgaagtgtttcgaggatatagaaagggtattaacgcaaaaactgtgatatggattcggtcgtgaaaaaaaccggagaattatccgattcagagataaagtccataaatacactctttttcgaggtatttggcttgcgaagagatatccttacggttcgtgaggagtgctttaatgctcctttgggatattccgtacatagtttgatgtatgacaagggtctcttagtcgcttattatgtatatatgcctttttattataagaaacaaggggaaaaattcattgcggctctagggtttgattcaatggtaaaaaaggaatatcgggatttctttactttttatgagacggaaagggcttgttggccttgtctccgaagtatagggtgtaagttgttgtttggttttccgaatgacgagtcttatccggttatgataaaagggtttaaggtaaaagatataggccgtttgaccacttatatccttccgatcaagattggtccgatcattccgaggatgagatggcttgatcctttctttagacttttttcttggtctctgatcaagatgtcccatttatccaaagggaaaaagattcgttcctttgtttttgaggaggatcgtgagtctttcgataaagtccgttatagatggaataaggggcaatatgagatacgggatataaaaggctgtaagtatgtttatcgaatagaggatcataaagatcgccatcaaaattttaatccagttaagaccgcttttcttttagatgtatatcctatgaaccgctcaaattttgagtttgcggtacgatccatataccaagagcgatcaaaggatattgatttgatcatgtatgtgggggatttaaattttgttccggtttcattgattaagatgcctcatagatttgaacctaaacattttcattttacttgtaatttaattgacaaatcatattttgatgatactctatatgatataaagaattgggacgtgaatctatcaaattacgatttattatgaagattctgacgtttgatatagaggattggtggggatacgattattgtaagttaggggacagatcggattgggaaccacgtttggataaataccttcggacggtactggatttattggaagaaaaaggaaccaaagcgactttctttattttgggagaagtggctgtctcaaatccggcagtcgttagaagtatagcggagcgaggacatcatattgggtgtcattcgttttcccatactttttggaaacagccaacggaaaaagaaattaaggaggatacctataaagcgttgaatgcgatagaggattgtatcggccagaaggtaacggcttatcgtgcgcccgcgttttctatcacgagtgagaattgttggattttgtctgttcttgcggaggctggtattttatatgattgttcgatctttcctaccagtcgcagttttggcggtttcccggagtataaaagtaagttccctagtaaaatagagatagatggagtatctatcaaagagtttccgatagctccatctacaatatggggacgtgaaatcgtatattcagggggaggttactttcgtctgttcccgtattctaagataaaggcattgacggttgattctgattatgttatgacttatttccatattagggattttgataaagagcaggcacgtacgtttgcgattctagaaggcgaatctgctcttacaaggtattttaagaattatgtaggcttgaattcctgttttaagaagtttacgagatatatttccgattttgatttttgtagcgtaaaagaagcggatgcggaaattaattgggaagagttacctgcgattcgtttgtaatttggtaggtagtgagtccttgtaattattcagttattatgtataaaaacttctttaagaggatgatcgatttcatcctcgtgttctgtgcattggctatgatctggccgatattattactgattaccgtatggttacattttgccaacaagggtgccggcgtatttttcttacaggagcgtccgggtaagaatggtaagatcttcaaggtcatcaagttcaagacaatgacggatgagcggggtgctgatgggaatttgttgcttgacgctgaccggcttacgaaagtaggtaagtttgtccgttcaacctcgatcgatgagttaccgcaattgatcaatgtgttgaaaggagatatggcgttgatcgggcctcgtccgttgttagtacaatatcttcctctctatagtaaggagcaggcacggcgtcatgaagtgtgtcccggtattactggatgggcacaagtaaatggtcgtacagctatatcttgggaaaaaaagtttgagttggatgtctggtatgtagatcacgtttctttcatggtggacttgaggatctttttcttgacaatatggaaagtcgttaagcgtgagaatgtggaaaataatgtaacatatccttttcgaaaagaataagatatttaggatgaggaatttattgataataggagccggtgggttcgggcgtgaggtatataattcagctttggaatctatagggtatggaaaggattttattgtaaaaggttttttggatgatcgattggacgctttggatacattttctaattatcctcctgtcatagatcgtattgatagttattccataaagcctgatgatgtatttgtttgtgcgttaggtacggtcactataaagaagaaggtttgtgagtctattctatctaggggtggtgattttttaaccttgatacataaagacacatatatatcaatgaatacgaaaatcggtaaaggttgcattcttttatctggtgctcggattcactgtgatgtgagtattggtgattttgtcgtcgtacagccttatgctattataggacatgatgtagtgatcggagattggagccatataaatgcgttggcagattgtggtggtggatcaagaattggagaatgtgtgacattacacacctctagctttgtgcttccttctggaattgtggaggataattccacggttggggctggtagtgtcgtcttgcgtagagtgaaagaagggagcacggtgtttggtgttcccgctaaaatagtattaactcctaaaaaacaatagactatggatggtattataataagagatctggatgttttcatgattcagcaatatcagcaaaatagatatccttgtttattcattgattacgtgtgcgagcttgttccggggaagttcgccaaaggatacaagaatttttcttttaatgaatggtttttcccttgtcatttccctgacgagccgaatgtcccgggttttattcaaatagaggccttgacacagatgttcttgatgacatttttatcgctaccggggaataagggtaagaagactagttttgttaccgttaacaatgcgcacttcaaaaagaagatagttccggggatgagacttgatattgagtcgacctgcaagatgtaccgtagaggtgtggcgattggtagctcaaaggggtacgtggatggtgagctagcctgtgaggctgagttcaccgtggcaattcccgatgtgttgaatcagttcaaaccaaaagaataatggaaagagtagcggactacgtgataaataggcttgtggaggaaggcgtgaagaccgtattcttgataacgggtcgagggatactgtatctctcggatgcgatagctaaaaacgaagaactacagtctgtgtcggttcaccacgagcaggctgcggcttttgcagcgaacgcctattcccagtatagtgagaatctgggcgcttgtattatttctacaggatgtgcttcgacaaatgctattaccggagtgctgaacgcatggcaggatggcattcctgtggtttatatatcgggtcagaacaagctgagggaaacggtggggtacacaggcaagacggtgagaacctacggccagcaggaagccaatgtgattcctttggtgaagcccatcacgaagtatgccagctttgtgatggacccccaaaatattggggtggagatggacaaggccatttactatgccaaggaaggattcaatggtccagtatggttggatattccagtggatgtgcagaacatgcgggtggaagaaacggaacttgaccgttggtcacccgatgtcaggactaagagccaagagcgaaggggtaaggagatagatgatgtcaccgctatgatagaaaaggcagagaggtcagttttcttaatcggcaatggcgtgagagcggctcatgctgtggaggattttgaggaattagtaaggaagacacggattccagtcgtgttctcaaactcggcggtagatatttatggaaccgccaatgagctgggtattggtactgtcggtgtgctcggcaataaccgttgcgcaaactttgcgatccagaattcagacttggtcatttccatcggttgtcggctatccaccattaccactggttctgagtatgagaagttcgctagagcggccaagatggttgtagttgacatccgcaaggaagaacaggataagaatacaatcaagattgataagctcatcattgatgacgctaaatcattcattcaagaattgctcggtaaggaactcaagcaaacaaacgaggcctggacggacaaatgcaagcattggaagttgatattccccaagtgtgaagatatttataagcatagcgataaggtcgatatctataacctctgtgaagtcctttctaggcacttggaagataatgccgtggtactgagtgacgccggcatcgaggaattgcttgtgccttctacgatagacttcaaaaaaggccaacgcatgttgcatcccgcctcacaaggttgcatgggtgtagcccttcccgccgcaatgggagcatactttgcctgtggtcatccggttaccactatcaatggcgatggttccatcatgatgaatcttcaggaattgcagaccatcgcttataacaagatgcccatcaggattgtggtggtgaacaataatgtttactccgtgatatggaaacgccaaaaggaacttttcagacgaaggaccattggaacaaatccagaggatggtgttggggtgcccaacttccagaagctggctgaatgtttcgatatcaaatatatgaggattgaaggaacaactacattggaagaaggaatcgtgcgactgatgaaagaggatggtcctgtcatttgcgaagtcatggccgtggaggaacaggattatatccgcacgtccgccgctttcaactcacgacgcaaattcgtgaacaagccaatcgaggatcaatatcctttcatcgatagagaactgtttagtagcgaaatgatcattgaaccaatagatttataaagatatggcaagattgacattaagagacggtatggtcctggaggactatgggaaaccatacattgtggcagaggtaaacagcagccataacggtgatgtggacttggcgagagctatggttgacgctgctgccgaggctggttgccattgcgtgaaatttcagtcatggtcggcggaatcgctttatgccgctgagtattataaagagaatcctatctctaaacgtttctttttgaggttctcgttgagcgaggaagaactgaagagtatggcgaactattgccgtcagcaaggtattcagttctcttctactccctattcgaaaagagaggtggattttttactcgatgagtgcggcgctcccttcgtgaaaatcgcctcaatggatttgaacaactatccttatttgcgttacgtaggcaagaagaatgctccgatagtgttgagtacaggcatgagtacaatggaggaagtgaaaaaagccgtggagacaatagaggaggttggaaactcacaaatttgcttgctgcactgtatttcaatctatcctccagatttgaacaccatccatcttaacaatattattggactgagagatttatttccgaactatccgataggtttttcggatcatagtataggttgtgaaattgcaaacgccgcgaccgctctgggtgccgtattgatagagaagcatctcacccttgaccataagaaaattggtatggacaatcaaatggccatggaacccggggatctgaagaatctcgtgagaggatgcaataatatatatgaggctatggggcataaggaacgagtgttgatggaagccgagattgagcagaaaaagaaaatgcgcagaagcataattgccgcaagagatcttaaggctgggactgttatctctgcggatgatttagatgcgaaacgcccggggacaggaattgctcctagccgtatggattcgctgatcggtaaaacattgactcgtgacgtggcattcgatgaggtatttaaggaagaggattttgagtgatatttacactaaggtttaatattaaaataaattatagaacaatgacaaatttagaaaagtacacccatacattcgttgagacattgggtatcatggcggaacagacaaatggtttgatgtatcaggatgtggaagcatgggattctgtaggccacatgactcttgttgccgcattggaagatgcttttgacatctctttagacaccgatgatatcatcgatttgagttcattcgagaaaggcctggagattttggctaagtatgatgttcagttttaatggacgtattctggttaaatattgacggtgaagaagtattgctctacaggtgcatttacgcacctgtaaaaagcaatatgttcataatggttaatggcaaggaggcgatagtgattgatcctaatgataatgaggagggaattctattgttacagggtaagaatgttgaaaatgtacatttgatacttacgcatgaacatttcgatcatacgttaggagtaccgaagattcaagaaaaatttcctcagaatgatttgttttgccaagaggaagccggaaggtctatttcgagcaaaaagggtaataatccgatgctgatagcttttgtgctagccgagcaggatcggacagacggaggtgatagatataaggatttcaaatccagctatcggccttatgtcttgcatgcggacgaaatttttggagagtctgcccatagagagatttgtggattgagatttcattttatccatactccaggccatagcggaggcagtagttgcgttgaattggggcattatgtcttctcgggagacagtttactgaaagaggagcggacaatcttgaggtttcctgaaggggagaaagaaaagtatgaaaatataaccttgccttatctgagaggtttgggcaaggaaacgataattattccgggtcatggtgatccgtttagaataacggaaagtaaattcttatgggattgaatatcattaccgacaggggtgaaagattctctgcggctgagctgaagggactgactgatgagtttggcaggcatctgcctcaaagatcattggtgtttctcttttgtgagaatgtcatcgggtcgctgatcggctatttgggttgtctggaaaatagaagtgttccggtgatgcttgatgcgactaaagactttgacatgctgaagcatttactggaggtgtacaaaccgaattatgtttggatgccattaaggattaagagcgaaaaacttataagtgaacctgtgtacgagagatttagttatgggttattcgaatattgtagagatcacgttaatctgaatgatgatttagctttgttgttgacgacctctggcagtacgggctctcctaaattggtaagactgagtaatgagaatatcaagagtaatgcggagtcaattgctgagtatcttgatattacctctgaagagagacctatcacttctcttccaatgtattatagttatggtcttagtgttatcaatagtcatcttttgaaagacgcgacactcctattgaccgacaaggccgtgattcaaaaagagttctgggctttcgctaaagaacaagcggcaacaagcattgcgggtgtaccatatacttatgagatgcttcgtcgtttacgtatcttccacatggatcttcctgccttgaggacaatgacacaggctggcggtaaacttagctcaactctcgtgaaagagtttgttgagtgggctcaagcgtcaggacgtagatttatcgtgatgtatggccagaccgaggctaccgctcgcatgagctacaccccttgtgaaaaagcgcttgaaaaatatgcgagtatcggaatcgcaattcctggtggagcgttctctattatagatgcggaaggaaatgagatcacctcgacggatacggatggcgaacttgtatataaaggtcctaacgtgtcgatgggttatgcggagtgtatcgctgaccttgctaaaggagatgagaataagggcgaacttcacactggcgatgtcgcccgctttgatgtggatggctatttctatatcactggtcgtttgaaaagatttgtgaaaatatggggtaatcgttgtaatctggatgctatggaacagcttgtgaaagcgggtgttactactgagtgcgcatgtgcaggtgtagatgatctggttacaatctttgttacccaagaaggccttgagcaagatatcaaatcattcctttcaagtaagatgggcttgaacgtcagagcgtttgtcgttaaggtaatcgatgagattcccaagaacgcatcgggcaagactcaatacgctgaacttcaaaatatgttgtaatggatatcaacgaaattctaaatatcgctccttattcattggataaagagcaaaaacatcagctgcttaatgatagacttcatgatttgactcttcatcattatgagcggtgtccagaatataagagaatggttgatgcttatggtttggatgtcaacaatcttccagactatgaggaactgcccttccttccggtacgtttgttcaaagagtttgagttgcttagcgtggaaagggaggaggtggtgaagacgatgacttcctccggtacgaccggccagcaagtatcgcggatctttctggatagggatacctccacattacaaacgagggccttggctaagatcgtatcctctttcataggaacgagacgggtacccatgttgatactagactctagtggcgtaataaaaaaccgtaacatgttttctgcacgtggggccggtatattgggcttctccatattcgggtctaaaaaaacatatgccttggacgatgacatgggattgaatatacctgtgatacaggatttcttggaggagcacctaggggaacctatctttatgttcggctttacttttatgatatggcagcatttctacaagcagttgatggagacgggatatcaccctgatctaagcaaggggatcttgatacatggtggaggttggaaaaagctggtgtcagagtcggtttccccgcagagatttaaggaatgcttaggtgaggcatgtggtatagacgcaggtaacgtgcatgattattatggcatggttgaacagaccggaagcatctatatggaatgtgagtgcgggcatctccattcccccgttttttcggacgtattgatacgcaaggcggatgattttggcctggccggtatcggagagaaaggcatcatagaggtggtttctatccttcctgaaagttatcccgggcatgtgctgctgacggaggatgagggggagcttcttggagaggatgattgtccctgcggcaggaaagggaaatattttaagataatcggtaggataaaaaatgcggagatccgcggatgcagtgatacttatgcggcaagattttgagaataaggatatacaagtcttatgcccagggggtatgatatggaatgaatggggacaatatagaccggatgtccctttctcggatgtggtgatcgaatacttgagcacgttgtcttcctctttactgagagatcgggaaagccggttgtatccggatgtggtgacgttcgcgttcttctgtaggaaagccaatcttttggctcaaaaaaagaaatatgtccgggacgataacctaagactgggacgtggggtattgtttcatatagctccctcgaatgtgccgattaattttggttattcattggttgccggacttctgagtggaaattataatattgttagagtgtcctcaaagatattcccccaagtggatttgatagttcggcatatgttggctatggagacaatcggtatctacaaagaggtatcagaccgaattgtcttggtcaggtatgatcgaacaagtgatgcgacaaacttattctcgtctatttgtaacgtccgtattatatggggcggtgatactacgattgcccatatccgtcagagcgctattcctgccagatccttcgatgttacctttgcggatcgttattccatggccgtaatacgggctgataggatgatgcaagtaaatgatacagttatagactctcttgctgaagaattctataatgatacttatctctttgatcagaatgcttgctctgcccctcatcttgttgtatgggtgggagagaaggaacatatagaacgatctcacgaacgattctggaatgcggtatggaggcttgttgatcaaaaatatgagtttcaaagcgtattggccgtagataaattaaccgctttttatcgtcaagccataaatatgccaatggaacgagaatggacaaaggataataaattggttcttgtcaatatgaagaggcttgatgccagtattgatgatcatcgttgtgcgggtggttatttctcggaatatagggctgctgatttgaaagagattgtttctattgtcaaggacaaataccagacattggcctattatggttttgataaggaggaactggagggttttattactgatagccgattaaagggcattgatcgtattgtcccatttggagaaacaacgagtttttcatttatgtgggacggttataatttgattgagactctatcccgtgagtgctccattttttgagatgtgaagaattatatttaaaatcatgaacaaacgtatttacctttgcctcgcccacatgggcggtaaagaacaaatgtatatcaaagaagcctttgatacgaactgggtagtgcctttgggtccgaatgtgaatggattcgagaaggatctggaggattttgttggtgaggataaacgtgtagtggctttatctgctggtacggctgcggtacacttggcgttgatcgcttgtggcgtgaagccgggggatgaggtactggtgcagagctttactttctgtgcatcctcgcatccgatcacttatttaggagcgacgccggtgtttgtggacagtgagccgtacacatggaacatggatccggaactattggaagaggccataaaagaccgtatccgtaagacgggcaagaaaccgaaggcgattattcctgtagctctttatggtatgccgtatgactgtgaccggatcattgagatagctaaccgatatgatatcccggtgatagaggatgctgcggagggctttggttctaaatacaagggacaggtattgggtaccttcggacgttatggtgtattgtcatttaatggaacccgcgaccctaaccttggcaaggttatgctctaccaactgagctacttccgcattgtttgtttctcttttgcgagtgcaaaggtagtacaaatatttatactaccaaacattttcggtgaaaaatttaattatggatgtaaattttattaccgtttgtatcgacgacatattgtttgagggcttgtttctcctcagcgcaaggtccttccaccggattgccgataccgtttaaaagttcaaatttactaccgcatttcggacaaatggcgtatacggcagattcgtccacatctacgatgacattagcggatgcctcatgaggacaagcggcatcgaacgcaaagaatgccccggttccgttactggacaatccatgataaaccaatacgcctccaaaccctgtttgctcgccagcttggtctacatctttagaggtgtagatcttataagcctgtattgcattcaacgctttatcttgataagtcagatctagttccagatagaccgcacgatagggaatgcgagtctctatcgtatctgcgcaagataatagcgtaaacaagatcaaaagtggaaatatccgtcttatcttatccatggatcaatttcttttcagcctcgttcatccgttcgaaagagaaagaacctatcacgctacgcatcatggtggcgattggttcgttacatagattaccgatactgccttcgtgtgtatggttaacgctcttcgaaggaacgaatttaccggcctcgatatccaaacctacttgcttataagcgtcacggaaaggcattccggccaagacacggcggttcacttcttccacgctaaacaatagagaatatttatcatcgtccaatatatgctcgtttactttcacctcgcgcatcatatgagttaccatgcgtaagcaatccttcagctcgtcgaaagccggtaggaagacttccttgatgatctggagatcccggaagtaaccggaaggaagattattgctgatcaagatgatttgctgaggcaagccttgaagcttattgcatttggcacgtgtcaactcaaatacatccggattcttcttatgcggcatgatactggagccggtcgtgaactgatccggcagtttgatgaagccaaagttctggctattgaacatacaagcgtcgaacgctaacttggagagcgtagcggcgatacccgccatagcgaaagctacggtgcgttccatcttgccacgtcccatctgggcgtataccacattgtagtccagcgagtcgaaacctaataaatccgtagtcatctggcggtttagcgggaaggatgaaccatatccggcggcggaacccagcgggttacggttgcaaatacggtatgcggcttgcataagttgcaaatcatctaccaagctctccgcataagcgccgaaccaaagtccgaacgaagagggcatagctacctgtagatgcgtatatccgggaagcagtacatccttgtaccggttactctgggagatcaaaacgtcgaacaagccggaaaccaactcaaccaattcttgtatttgcgaacgggtgaaaagtttcagatccaatagaacctgatcattgcgggaacgcccgctatggatcttcttgcccatatcgcccaaacggcgtgtaagcatgagttccacctgcgagtgcacatcctcgatgccttcctcgatgatgaattctccacgatccgctacggcgtatatattccgtaattctgctaataagacgtttagttcctctttggtcaacaaaccgatactttccagcatcgtgatatgcgccatagagcctaatacgtcatatttagcgaggtaaagatccagctcacggtccttacctaccgtgaagatatctacttcatgatctacctgtacatttttttcccaaagtttctgagccataatgaaaaaggaattaataaggcaaggaggcgataacggtcgagattttatcgacagcctcttgcaaaggtttcgataccattggtttcaagaacggattcagatcggcacgaaccgtgatttttaaccgtgtgtcgtcctcggccacctgtttcaattgtatccacaagaaaaggggaacaggagagttggtcgtcgtgaacttgattaatttattcggctctctttctacgatctggaaggtaatcttaccaacgggatcgacagcgaaactacaggtatcgctgtcgaactcaaaattttttattttatcttgcgggatgcgatccttgatacgttccaagttggaaagatcggacaacatcgtgaagatacgttcatcattgtgtgggatctgtttgacctcactcacaaattcttcagtcattgagtgtttttttgtttattacttatttcgggtcccagttagccggatctttacgccattcctgaagaaccgcgatctcagactcatcgatgtaatgcgtacggacagcttcttccaagactgcgtcgtagttactcaatgtagtcaatgtcactttagcgtccttgaaagcggcttccgctacagggaatccataggtaaagatagctaccatacctgcgacatcgcaaccaaagttacgtacggcttgtacggctttcaagctactacctccggtagataccaaatcctcgatgatcactactttagaacccggtttcaattctccctcgataaggttttccaatccatgatcctttggcgtagagcggatgtatacgaatggcaatcctaataaatcggctactaaagcaccttgagcgatcgcgcctgtagcaacaccggcaatggcatctacgttctcgaatttttcactaatcacacgagccaactccaatttaatgaagctacgaacgaccggataagaaagagtctttcggttgtcattgtagatcggagatttccagccggatgcccaagtaaacggattggccggttgcaactttacggctttaatctttaataatttttctgctactaaactttccagtgttttcatacaatcctatatttatatcagtttgcaaaaatagataaactgaatgacattaccttgaatatcgtacgttaattttttattaatatttatgcgacagatagggctaaaatgctgatgcgtatgcccggaatccctgataaagcctttgcgcaagcggaaatcgtggctccggttgtgatcacgtcgtctatgagcaggatatgtttgttttttaagctttccggatgaatgacattaaaaatagaacatacatttaaccaacggtcgtaaatggccttacgagtttgggtgcttgtgtgggtggtgcgggccagactttgcgtatcgatggggatatcccatatggaacggatgccggaggcgatccattcggactggttgtaacctctttgccgttttttgcggggatgcaggggaacggggataaggaggtctacggtacatatcgggctgtgatccgcttggagctctctcgctatctgccgtccgagtagatagcccagctctttattatcatggtatttgagcgagtggatcaggcattgtacttttccacctttctcgtatcgtagataagcggtggcgtattcgatccggtcctttccgataaaaagttgctcgacggggttgttcacctgttgatgatatcccgtgtgcggcagatcacataggcatttcaggcaaatttgttcttctccctcgacgagtggtcgtttacatattttacataagtttgggaaaaacaggttgagcagattattccatgtcgtcggcataatcctcgcagtctatttctttgaataattgacttaggcaatccaacgtgatccggctttcgaaacctcgtccggcggcgaaacggagtaacttgttgaataggtcccgctcgtcttttcctttggtcgatttctttttgctttttagtaaatcgagtaagatggagcggtattctccctcgtcgatggcggcgagcgattcttcccggatcggggaggggatgtttttcttataaagctcgtagcctatttttacccgtccccatttattgaatcgtagcttatcgttcacgaagaaacgggtgtaacgggattcgtcgataaaccgctctttcagcaagcgggcgatgatacgctcggaggcgtcggggggaagtccggcggcatcgatctttttctgtacgtcttgtatgcagcgttcggcggcggagcaataggcggctgcccggtgcaacatctcgggttcggttatctctttcatattttcgcttttacgatacggtctttcccgtatagatcttgtattaattcgacttcggtgtaattctcttgacgtagcatcgctacggtctcttttccgcaaagggcattgatctcgaagtaaagatgcccgccttccaccaaatgcctttgtccgaagcgggcgatggcccggtagaagagaagcggatcgtcgtcgggaacgaacaaggctagatgaggctcgttctccagaacgttcgcttccatggtcgctttctctctatacattatataagggggattactgacgatgcagtttaagtttcctataagagacgcttcggtttcctccgtatgggattttagtttcacgtacgtgaaaattttgtttctcgtacatgaaaatctagtttcacgtacgtgaaaattttgtttctcttgcatgaaactggaataaccttcggaaaggatatccaattcatggaaggatacggaaacttgattcatacgggcgttctcctcggccatggcgagcgcttcgggtgatatatccaccgccgctacctctgccttcggaagatgtttcgccaaggaaatagcgatacagccgcttcccgtaccaatatctaatatacgaggggcttggccttggtagtccgtgatgatccgctcgaccaactcggcggtttccgggcggggaatcaatacgtccggcgtcaccttaaactccatcccgtaaaaatccgctatgcctaataagtattgtatgggcttgtataaacgcagtccttctacaatctccttgattttaaatttctccgtatcagataattctttacctttgcctaacaggagttgatgggtagaaagaccgcaaacacgttccatgatgagccggacgagcgcttgggcttcgccgggaggataaatatctttgagggaatttcggatgtaggcgatggtctcagtcatatcttactcttgttttatcgcgaaagtagtgtaaaaaccgtttatatgcaaagattatggtagaggttgaagagaaatacatggctcgttgcatcgagttggccaaaggagggaggggaaatgtcagtccgaatccgatggttggtgcggtggttgtgcataagggccgtattatcggtgagggatttcacaggaaatgtggggaggcgcatgccgaggtgaatgctatcgcttccgtgaaagacgagtctttgttgaaagacagtacgatttatgtgagtctggagccttgctctcattatgggaagacgcctccttgcgccgagttgattatccggaaagggattccacgggtggtggtcggttgcttggatccttttcccgaggtgtcggggcgaggcgtgcggatgttgcgtgaggctggtgtcgaggtcgtcacaggcgtgatggaggaagaagcccgtgcgttgaacaaggcgtttatgacgctacaaacgaaaggccgtccttatattatcttgaaatgggcgcagagcgaggatgggtttatcgatcgtttgcgtacggacgtgtcggagccggtcacggttttgtcttctccggagacttcacgcttggtgcataaacttcgctcggaggtggcggctatcatggtcggtacacggaccgctttattggataatccttcattgaacgtgcgccattggtccggtaattctccggttagggtcgtattggatcgccggctcgttattcccgattcttatcggttgctgaatggtttctcacgtacattaatatttacggagaaggaagtggaaaaccgagagaacatggagtatatccggatagatttcgagggcccggtgatccggcaagtgctagatcatcttgctgcccggaagttggattccttattggtggaaggtggggcccagttgattaattctttcgtggaagcggatgtgtgggacgaggcgagggtggaaacagctccggttcgcctgtatcaaggggtgcatgcgccgatgcttggaaaggaggctgttagcggcatctctagacgttctgttatgagcattaaaaatcataactatgaaattttaaatcataacgatgagttcgaaaaatcataactatgaattttaaggctcatataatcaactaaaatattataaatattagcaggtattagggtgaaagcaaaaaatgtttctacttttgtgcctttatatgcgacaaacttatgtttttgatgaaaaataaattagtactatttataacaggttgttttgcgttagtgctgtcttcttgtttgaagtcagatgaaatcgttggtgtagaagctattaagaattgccagatacatactttttcattaagtcatgattctgtgtcggggttggatactgtgaagtttacgatagaccagctaacgggacggatttttaatatagactctttaccttttggtacgaagatcgagaaagtggtttgtaagattgggttcgctaattcttcagtgataggtggcgtggaggctagtcccgaggcttatcccgattccacttattatttaagtagtttgtcggattccatcgatttctccgctccggtaaagttcgtggttcatgcgtatgaccaagtcacgacaaaagtctatatggcgcaggtgaatatccatcaagtggttccggactctatggtttggagtatgtacgcgaatcctatgattggcattaccgtgaaggatcagaaggtggtaacctacgattataatggatcggagaattactttatgtatgtgaaacccgccgagtccggtaaaccttaccaattatattacgcttcggtaagtgcgcctaagggctggcagtcattatccttggccggtctgccttccgatgggcttttgatctcccagattactgagtataacaatgctttatatgtgccggctacaaatggcacattatatagatccgaggatggcttgacttggagcgctgtagagaacgccccttccgtgaaatacgttttgggtagcgtgaagcagggcacgaaacagccttccgccttagctacgatcgtggatcaggaaggaaagctagcgttctatgcgatgaacgaatccatggagtggatcgccggagatgcggtggctagcggattccctgttaccggatttagcaatctccaatatgccgcaatgtatcatgagtacttgatgaccgccggcggacgtaccgcggacaaccaagtggttaatacgacttgggcgaccatggatggtatctcttgggcgttgatggcttccggtgacgcaaacttcacgaagcgtgagggagcgatgatcacgaattatgacgataagtttttcttgatcggaggtatcgacgcttcgaacaaggcattgaaagatatgtatcaatcgatagattatggtatttcttggtcgttgatcgactcgatggtggtgttaccgaccgactatgcggcgagaggcttttcctcaattattgtggataaagagaatttcgtgaacattttcggaggaaagaccagcactggttccaatgacttgaaccaactttggagaggccgtatcaatcgtttgatcccgaaggaatagaaaagttcgataggagatgtataattttatgaggcttttagcgttagaaaaagaagtgtggtatatataacagcaaggcttatgacttcaactttttttcagcggcttctcataatcatcctattagcgggtacggtccctacgctttgggcgcaggaatataagtacgagatcggtggtatggctggtggcgccttttatatgggcgacgccaacaagaatacgatatttaaaggaatgaatccggcggtgggagccgtgttccggtataacatcaactttcgttgggccttgaaagccaacttgatgtggggacaggtttccggtaagaccgaaggtatggagaacgtttttccgaataatgcccaaacctctttcaaccgtagtatcatggagttggggggacaggcagagttcaattttttcccgtatagcgataagttcgactatgcgggggcgaagcgtttctctccttatgtcttggtgggcatagggctgacggtggctccgggtggcgggaagactttcgccagcccgaatattcctttaggcgtgggcatgaaatataagatcaagaaccgccttaatttagggtgcgagttctcgtttcgtaagttatttggcgatggcctagagggaaaggacatgttggacgatccgtatggtgttaagggtagcgctcttaagaataaagattggtactctttcttgttgttgtctgttacatgggatttcggcccgaggtgtcgtacttgtaacaatgcgaaaaatataagtgaatattagtaagataaaaaatgtcgttgattgagaaaatagacaagaatcgcttgccacggcacgtggcaattattatggacgggaacggacgttgggccaaggcgaaggggaaagaccgtagcttcgggcatcaggaaggcgttgtttcggtccgtaagattatggatgcggtcactcaactcggattgaaatatctgacgttgtacactttctctaccgagaactggaatcgtccggaagaagaggtccaagcgctgatgagcttgctggtctctgccattcaccgggagactccggacatgatgaagaaaaacgttcgccttaccgccataggcgatctttcccgtttgcgtgaggatgcttataatacattgcaagaatgtatcgatacgacttcggcgaatacgggaaccacacttgttctggcgcttagttattcttcccggtgggagatcaccagagcggctaggcaactcgcccaagaggtcttggaacagaaaataaaccccaatgatataaccgaggctatggtctcggaccacttgacgaccaaaaatatccccgatcccgatcttttgatacggaccggaggagagaaacgcatcagtaacttcttgctatggcagttgtcatatgctgaattcttctttacggatgtgttttggccggatttcagagaagaagagttgtatgaggctatattgtattaccagcaacgtgagcgtcgtttcggtaagacaagtgagcaattaatcttataaacaatagctgttatatgtacaaaagaatagtgctgttttttatttgcttgggtttcgcttgcggtgcgtttgcccaagaaatagacactacccaagttgaggcgccggcagaagtgccggtcatttcgtactcgttagctccgaagaaatacaagattgcggatataaagattacgggtatcaagaattatgatgattttgtgttgatcggcttctcgggcttgtcggtaggcgatgagattaccgtaccgggagaggagatcactacagcagtgaagcgtttttggaaacatggcttgttttcggatgtgaagattttggcaacgaagatcgagggcgaccagatttggctggagatccagctgaagcagcgtccgcgtatctcgcaagtcaattaccacgggatcaagaaaggcgagcgtgaggacttggaggcgaagctgggtttgaagaaaggttttcaggtgacaccgaacgtcatggaccgtgccaagatcgtgatccagaagttcttcgatggcaaaggctttaagaacgtggatgtcgagatcgagcaaaaggacgatcccgcgaatgaaggcgaggtgatcgtggatatcaatatcgataagaatgaaaagaccaagatccatcgtatctattttgagggtaacgaaaaactgactgcccgggagttgaagaaggcgatgaagaagacgaacgagaagtttagcttgccgaacgactggaaaaccagtatcatggagatgttcagcacgaagaagttcacgactgaggaatatgagaacgataagaaaaatataatcgctaaatataacgagcatggttatcgcgacgccgtattgttgtttgatagcgtagcgaactttaacgagaagaaggtagatatcttcttgaaagtggatgaaggtgagaaatactatttgaaagatattcgcttcgtgggtaatacgcaatattctacggactatttgatggccgtgttgggtatgaagccaggcgaggtgtataatcaaaagaaattgaacgaacgtttgagtacggatgatgatgccgtttcgaatgtctattttaataacggttatttgttcttcaacgccgatccggtagaggtggatgtagcgaatgactctatctcgttagagatccgtatccaagagggtccgcaggcgacgatcaaccgtattatcattaatggtaatgaccgtttgtatgaggatatcgttcgccgtgagttgcgtaccaagccgggtatgttgttcagccgtgacgacttgatgcgttccgttcgtgagttggcccagatgggacacttcgacccggaaaacatgaatccggtgccgctgcctgatcctgagaatggaaccgtggatattgagtataacttggtttccaaggcgaatgaccagatcgagttctccgctggttggggacagacgggtgtgatcggtaagttaagtttgaagtttacgaacttctctatgaagaacttcttgaacccgaaaacctataagggcatcatcccgcaaggtgagggacagacattgaccttgagcggccagacgaacgggcgttactatcaggcttacagcatctccttcatggatccttggttcggcggtaaacgaccgaatacattgtctgtcagcgcttatttctcaaagcaaaccgatatcagtagcaattacttgaccaattccggttatggttatggctatccgggctatggctatggttatcccggttattatgggggcggttatggctatggtagcaactattacggcaactatggttacaataatagttatgagtatgcttacgacccggataagtctatcatgatgttcggtttagcggctggttatggtaaacgcttgaattggccggatgactacttccagttcatggcgacgttgaactatcagctgtatatgatgcatgattgggattatttcttggttaataacggaaattgccataatatcaacttggagttgatgttgcaacgtaattctatcgataacccgttgtatactcgtaagggttcacaattcatgttgtctgtagctgctacgcctccttactctttattcgatggtaaggattatgcgtcgatgtcaagctcagacccggataagtataaattcatcgagtatcataaatggaagttcaaagcgaagatcttctctccgttggctccgttgaccgtgaaacgtacgccggtattgatgacccgtgttgagtatggtttcttaggtacttataataaaaataagaagtctccgttcgagaccttctatatgggtggtgacggtatgagtggttactccagtacctatgctcaggaaacgatcggtttgagaggttatgagaatggtagtatcgccggtaatggtggttacaactcttatggatacgcttattctcgtttggctatggagttgagatatccgttcttgctggagccttcctctacgatctacggattggtatttgtggaggctggtaacgcttggactgatttgaagaattttaatccgtttaacttgaaacgttccgctggtgtcggtgtccgtatattcttgccgatgatcggtttgatgggactcgactgggcttatggtttcgacgagccgaattatggatctaatggtaaacgtagcggtagtaacctgcactttatcatcggacaggaattctaaaatatagatcgggtatagcttcgtatgtagagacggggcgtgttccgtatgtggagacggggcacgccccgtctctacatttaaataaatacttttaacgaatattggtaggctgtaagtaaaccctctgttatatttgcagtcataaagtagaactataaataaagagagtatgaaaaagattatcacattgagctgtctgatgttgctttgttcttttgtcggcatggcacagaagttcgctttaatcgacatggaatatatattgaagaatattccggcttacgaaatgaccaatgagcagttgagccaagtttccaagaaatggcaaaatgaggtggaagcgattcagcaagaagctcagaatatgtataagaattatcagagcgatctggtattcctctccgccgagatgaaaacgaaacgtgaggaagagatcgtgaagaaagagcaagaggcgcaagatctgaaacgtaaatatttcggtcctgagggtgagttatataagaaacgcgagagtttgatgaaaccgattcaagacgaggtgtataatgcggtgaaagaaatctcggaagacaagggatatcaaattgtttgggatcgagcttctgccatgagcattattttcgcttcgccaaagatcgatatcagtaatgaagtgctgattaagttaggatattcaaaataaatgcttacatttgtgcgctttatgcatgaaaagtgtgaaagcttgattaataacaaagtaattatatagtaaaaatgaagaaacttattgttttattgttgatgattctcccgttgggagctatcgctcaggaagttaaaattgcgtttgtaaaaactcaagaggtgtttatggctatgccggaggtatctggtatggaaaaacaaatggcagacttgaatgagaaatatagagttgaattgaagcaaatgcaagatgaataccaaaagaaatattcagacttcgtagcgcagcaagattcattgacagaaaatatcaagttgagaagaatgcaagagattcaagatatccaagaacgtatggataacttcgttcaggtagctcagcaagacgtacaaaagaaacaacaagaattgttgcaaccgatccaacagaagttgcacgaggctatccagaaggtaggcgaggagaagggatatacgtatatcatcgatccggcagctttgctttatacgggtactaacgcggtagacgcaactccgtttgttcgtacgaaactcggtttgtaattagcgagaaaatttattctatagaataaaagagagggtgttttccgaaaggattgcaccctttgtactttataaaagaaggtttctgatatgtttccacaaactcccggtccgatcggtctttttgattcaggttatggcggacttacgattttcgataagattcatcagttgatgcccggttatgattacgtttatctgggcgataacgcacgttctccttatggaacccgttcgttcgaggttgtttatcaatttacccgtcaggcggtatcgcgcttgtttgagtcgggttgccaattggtgatcttggcttgtaatacggcatcggcgaaagcgcttcgtacgatccaacaaaaagacttgcctacatgggatcccaatcgtcgtgtattgggagtcatccgtcctacagttgagttagtggatacaatcagccgtaccaaacatatcggtatcgtaggtacgagcggtacgattacgtccaattcttatacgatcgagatcggcaggatgtatccacatatccaagtgacaggcgaggcttgccccatgtgggttcctttggtggagaataatgagtttaattccccgggagcggattatttcgtgaaaaagcatatcgaccatctattatccgtagatccgcaaatcgatacgcttatcttgggatgtactcactatccccttttgatggataagatccgtgcttttcttccttccggcatcactctattctcgcaaggcgagcatgtagcggagagtttgcgagattatttagggcgtcacccggaaatggatcgtaaactcacgaagggaggaagttgccgttttcttaccacggagtcggcagagaagttttctgaggcggcctctatcttcatgaatactccggtctcggtttcccagatcgagctataacgcccctaggccctatgagggagatgtatatgaacgctatttatacttccctccttccttatgaatacttgaaagatatcggatgaattcatttgaatatctagtataattctacagatcacgccgtggtctgtagagttcacggcgtggtttgtatagttcacgttgtggtctgtacagaccatgacgtgaattagaaaataaaacaaggagcgagaacgtataggtatagaaagaaataggtataataccttatcctatcttaaattcttgccggacgtctgccttctacggaaaagttagatgctttcttattggatgctctttccgaaaggagccaaggctaaagctgccatcttaaaatgttgcatgccgaaagggatgccgatgatcgtgatacatagcaaaaggccgaatcccagatgcgtaaggcaaatccaaaagcctccgacgaatatccagataatgttcatgataagtgacaagcatcctccggaattcccctcgtctacgacacggctgccaaaaggccataaagccagtatcgctaattttaaggtctggaggccaaaaggtataccaatgatcgttatcattagtattaggctggatatcagatattctacacttgttataatccctccgaagagtaaccatattatattccccaagaatttcatacgctagttatttaaatggttgatactatctttctcatatataacagatgctttactaactgtggctacatgaaagctatctatttccgccaagatttgccgcttaacgaaagcgaaactatccctataggccggtttcaccggttcagaagggggagcttccatttttagcggatcgataggttgcccgttcttatggacacggaagtctaggtgcggcccggtagagagtccggtggagcctacataagcgatctcttggccttgttgcacatggctgcctacttggattcctttggcgaagcggcttaagtgcatataagtcgtggtgtatacggagttatgtttcactttcaggaaattgcccccgccgttttgatatcccttggcgataaccgtaccagctccgatgctgcgtaccggtgtaccggtcggtgccgcgtaatcaaccccatgatgcgcccggtatcgtttgaggatcgggtggaaacgggcgttcgtaaaacgggatgtgatccggaaaaagtctaatggggctttcaagaacgctttgcgaaggctgttcccttcctcatcaaagtattcgaagatactgtcttgggtgaaaggaatcgctacaaactctttgccttgatgcgtaaagatcgccccctcgatagaggcgatgctcaaggcggtggtatcgtcgatgtaagcctcattgtatagaaccttgaatgagtctccatctttgatatcgaagaaatcgatttgccaagcgtacacgtccgatatcttgatcgccagatacggatcacctccattggccttgatcacgttccatagggaagagtttaagactccttccgtatattttttcttgagggtgatcggcttattaaattcataggcgttgatcgtatctccggtcaagtcgattacggcataatcggtcagcgacttggcgaaggcgatatatcggatcgtctctaaggaatctaccgtggaaaatgtgtaataatgcatgccggctcgcagtttcgtcggatcgaggacatgggtggatgccctgctgatactgtctgctttcaaggccgtgaagcccagcccggagaagatggaggcgggattatccccgtttttcatcaaatactcttttacgtccaaggaatcgatacagatgccgtattgatacagatgttgtgagctatccacccactgcgtatccatgtccgcgtcttccgtgggctgttggggctgtttgcaggagaaacaactcatcaacatgactaatacgatacatataggtagtttcttgtccatttgtcttcgtttgttcatcaaaaattattcaaccggatacaaacttacggaaaataatagaaatagcgaaacctatttagcgtaaagctttgtaccttcgcggactcgtaaaaaggtgtttaggtagaaagcagatcaatggacatgtatagactattccgtgccccgagagggctgagaggtaaattatttaaattaacagggcctatctttctggaaaccttgctgatgttgactttaggcgtggtggatacgcttatgttgagccatcattccgataatgcggtggcagcggtaggtgtggttaatcaattgctgaacatggtattcctgctgttcaatattaccacgaccggaacttccgtcatgtgcgccctttatttcggggcgaaagataataagagttttattcaggtgttaggaacctccttgttgtttaacgccggcgtaggttgcttgatcagcttgatgcttttcttgttcggtagggagatgttggtcctgatggatatccgtccggatctgatgccggacgctgagacttatatgcacattgtcggagggttcggcttcttccaagcggttagttttacgatatcggcggtgctccgtgcggcgaacaagccgaattacgcgatgcaggtgaccttgctgatcaatgtattgaatgtgtttggaaattatgcgttgatatttggccatttcggtttccctgccctcggtgtacaaggagcggctatctctacctctgtttgccggggagtggcgatgacacttttgtttatcatgctgttcaagcggttggtgcctcgtatccctttggcttatttccgtccgttcccgtttcagaagttgaaagatgtgttgaagatcggcttaccttcggcagcggaacaaatctcgtatgatgcctcgcaggtgacgattgtctactttatcaatatgctgggtaatgagtacttgacagctcgtgtttatgtgatgaatatcgtgataatcggctatatcttttctttgtcgatcgcgcaagctacttctatttgtaccggcaatttggtgggcgcgaggaagaagcaagccgcttatttattgagttggtatgcttggaggaggtcgttgctgattacgttagtcgctagtaccggggtttatctgctgggacgtcctttattggggatatttactgagaatcaagcaatcataacgatcgcgatgggagccttgctggtagatgtactcttggagcaagggcgggccacggtactgctgttcttattctgcttgcgttcggtaggcgacgtcgtggtcccggtaattatcgagttattctgtatgtggttctttgccgtgttctgcgggtatatgttcggtatcgtgttcggattaggcttagcggggatgtggttcgcttttgctttggacgagtgttccaggggagcggtactctgtttgcgatggcgaacgcagaagtggaaaaagaggatgttaatcaagaatcctgttaatataagctaaaacagggtgttcttgggaacatttcgccttctatttgcgtcttactaattacaatagatattttataaaagattatgatgaagatgaaaaaggtattgttttatgcgtttttgcttcccgctttcgttgggatgatgttttcttgttcagacgtcaagacagatgtgaagaagttggaaggtaaatggaatgtggtagaagtgaaaggtgagaaagtcttggaagaaggcctgccgcagatggacttcaatatggctgagaagaaattacatggaaatacaggctgtaatttattcaatacgacgatcacgttagatccggaagatgtatcttctattacgatcgctccgggcgctacaactatgatggcttgtccgaatatggatttggagacgagcgtgcttcaatcgatggatcaggttcgttccgtgaagggcggaaaagatgagaatgagatgttgctggtagaccaagatggtaatgtattattagtattggagagaaattaatgcgaaaaggtcttttttatatttgcctgcttttggtaggcgtcggtttgttcgccggctgtaaatccaagaaagcggtggtagcttctttctcggatctggatggtgaatggggtgtcgtggagatgaacggtaagacgttgaatcccgaggagactcatcaggttttggtgttcgacgtggctcgtcaagggctttcgggaaatgccggttgcaatcggttgatggggaagatcgaatataatgatgcttatagaaatatcattaagttcccacaggtagcgactacccgaatggcttgcccggatatgagcggcgaacgtgagttgctggaagcgcttaataaggtggtgcgctttgaggcacagggtgaggcggctcctgtttcggaaatcgctttgttcgggaccaataatgataagttgttggtgatcaaaaagcaaaaataaaatcacccagttgtagagacggggcacgccccgtctctacaactgggtattaatatttgaaactataacggaatcctgccttaaaccaaatacccggttgggggatatttcccagatcataataagtggaattgagcagattatttaactccgcatatagatttaaccgctgatattcccaatttactttcatatctactaagcaataaggagcgtaaggttcctcataagccggcttaagattctcgtatttagtataactgccggcccggtcttgccaacggacataccaagtggccgaaaaacctttccagatagaatggcttaattgagccgtgaacttgtgcttcagataatctaacgcataattcgatatatacccctcactatccttgtcttgatggataaacgcatatcccagttctattttccggataaagaaccgttcattgcccagttccctcggtaataaactcaggttagtctcgaaaccaaggttatcgacttttgtcagatttcggctttcccagatatcttccggtttctctttcacccaatcgatcatgttcttgccttttcggtaaaagccggctatatgagcccggaggaagtaagtgttgtatttcagtccgacctcgaaagcctcgctttcttccggttttaggtccggatttcctttattcgtcttaccctcataataaagatcggtgaaagtcggcatacgcaatgcccggttccagctcccatacagacggacattgtccccgatacggtaactggcatctattcccggatagaaatgaatcccttcgtttaaggccgaattatagtttaccaaggccccgactgacaacgtgaagcggcgtaataatacgttatgctcaagaaagtagctgatattacttcggttatcgctttttagatattgcccctctttctcgaaaggaacatcctgcggttccttcatcggcttgcctaatacgttactctttactccctcgtttcggaattccacgcccatactggttcttcctagtttccactgtgtcgtggcgttgaggttggctccgaatacttccgtctcatggtaattatgcccggtataccaatcggcgggatcgctacgaaacaactcgtaccggtcgaaatgtcgggtccagtataccttgggggtgaacttgattttgccatgtgtttctcctccggcggagaggaaaaagctgcgagtcttgtcgtattggttggggtaggaagcggagtagaagctattcgctccataacctttgtcgttgtatccagcttggaattggaaatcggcctcctcgcttttaagttccgattgccaaaaaagatttaattgtttgaagtctgtattgtctatataccctccggacgaggcataccctgcggaaaggcgctgtccgaaatgagtggtcgcgtgattgatggcagcttccagtttccagagcttatgcattccagcgtaattgtcggtcgagatcctgttctcttttcctgttttcgtgatgatattgatcgctccggcgaaagcgctggccccgaatatacgggaagaagggccggataccacctcgatgcgctctatgtccgagagattcaccgggaggtcaaaactataatggccagtttgtgggttggagaggttgaccccgtttaagagaaccgctatttggtcgaacgtccctccccggatggagatatcggcttgggtgcctccttctcctcgttgccggacgtctattcccgcggcatattctaaaagatcctggatactggtgacaggtgccgccgcgatctcacgggcgggaatgactgtcacgatcttggtcacttgattccgtgcgataggcgcacgggaggcggtaacttctacctcttccagctctacggaagcttcctcgccggtccggttaggctcgattgtcttttgagcttgcgccgtgtcgggcagggcgaatagtagcgtacttgctgttacgactccaatgttaatgactttgtgcatactccggaacacggcgtaacgtttccggtcgaatcggcggaaacgtacggcgacttgggtatgcgattcccaataattcattcgttcttattttttattttgagtaggatagtccggataaagtaaatactttttacgcatggccttgtattgatccagctcgggtttccaactttcccggatctctttctcggataagccccttacgatctggtagcggagctgctttgtgcctgccaataaatcgaaccagttcggacgggagaagaaaaaggcttgatcctttcccgctttattgtagaagtcgaggaagaatcgcaaggttaatcctccttcgaacggatattcccgcagatcgatgccgtaacatactttatccttttgcaaaggattggtatcgaatccgggcaaggaggtcggggtaaaagtgaaatccccgtatttaggatccgggaaacctagtacttgaaacggataataggttcctcttcccacgctaacgttcgtagcctcaaaaaagcaaagcgacggatacaggcggatagactggtcattcgggaggttcggagagggcttgaccggcaaccaatagggatctccgtgtttccaattctccatctttacgatctttaaccgacaggtatcgggcgtacttttcagccagccttccttattgatcatccatgccaattctcctacggtcaagccgtgcaagatcgggagcggatcgacaccgacgaaagactcgaatcctttctggcggatcggtccgtctacgaagtcattcgggttcgggcggtccaacacgataaactctttgttgttttcggcgcaggcttccatcacgtaatgcatcgtgctgatataggtatagaaacgggcacctacatcttgtatatcgaaaacaatcacgtcgaggtcgcccagttgctcggcggacggtttcttgtttttcccataaatagagatgatggggatgcctgttttcaagtctcggctgtcttttatctcctctccggcatcaccggttccccggaatccatgttccggagcgaacaccttcttaacgtctacgccttccgctactagcgcatctaataaatgaatctgccgcttttccaagatggaagtctggttgaccactaatcctacccgcttgcctttcagtaaacgagtgacgacatccatccgctcggcacctagctttaacggggcgttttgtgaatagaccgttggcgtcaggctaaaaagtatgactagaaatataaagatctgtttcattacatatataataactgtatactaaccgcaaaagtacgaaatgtttttcacagaaagtttatacttttgaggcgaataacagacaatactagaatatgaatgtaaaaacacttttttatgcggtagccttcttgagtttatcatgggcgtctttcacctatgcgcaagatgtcctaccggaatatacgcaagcacgccgtttcgccccgtcgaatgcggaacagttacttttctcttatacccttacccccaattattttaataatagtaacaaattctggtacgagtataagacgagtgaggggacaaactggtatctggtggaccccgattcgagaaataaacgattattattcgatcgggatgagttggcggcacagataagcgagatcgtgagagagccttttaccggacaacaacttcctatcgaagatttacgcttaaaggaagatgatcgcacgtttactttctcgataaagggtacgaacgggaactattttttctcgtatgattatccgtcctcccggttgactcggattacgaaagacgagattcctgctaaaatccgttgggcgaatatatcgccggataaaaagcgggtcgtcttcgcaaaagatttgaacctgtatgtcatgagttatgaggattatgagaaggccgtgaagaatccggaggataagacgatatccgagatcgccttgactacggatggcgaaaaagattttggctttggtatgccccggaccttcttgaataccgatactttatgtgaccataagcggaaatatgtaatggggaactggtctcccgatggtcgttatttcgtcgcgactttgtcggatcaacgtgaggtgcaagatttatgggtgattaactcgatcgccaaacctcgtcctacacttgagacctataaatatcagatgccgggagaggcgggttctccaatcgttcatttatatctctttgatttggaaaatgccggaaagcggaaagaaatccgggtggattgttttaaagatcaaataattaatctagcctccaaaccggataaggagcgtacgggactcactcggaactcgatctggttgggagataaccagaccttctatttgacccgtgtcagccgggatatgaaacgggtggatatctgttcgtatacgatcggggaggattcggtaaaagcgatcattgaggaacgtctaaatacctctatggaaacccgcccgctagcgatgaccgataatggtaaggaattgatccattggagcgaacgggatggttgggcgcatctgtatctatatgacgcgcaaggaaatttgaaaaaccgtatcaccaaaggaccttggcatgtggacgccatcgtagacgtggacagtaagaatcgagtcgtttacttcaaggcgaatgcccgggaaaagggagatacgactccttattacgagcatttgtatcgggtgaatctggatggttcgggcttaaagctgattactccgggcgattatttccacctggtctctatggataaatccatgcgatatatcgtggataactattctcgtgtcaatacgatcccggctacggcattgtatgataaccaaggtaaccgattgatgaccttggaggagagtgacttctcccaattattcatggcaggttataaattccctgagcctttttcggtaaaggcggccgacggggtgaccgatttgtatggtgtcatgtataagccttttgattttgattccacgaaagtatatccggtcattaactatgtataccccggaccgcaacaggagggaactttctttcgctacatcccgatgaatcctcgtacggatcgtttggcgcaagccggatttgtcgtggtgtgcatgggacataggggagggcatcccagtcgctccaagtggtatcataattatggatatggaaatttgcgtgattatccgatggcggatcataaagtagctattgagcagttgtgcgctcgatataaattcatggatatcaaccgggtcggcatacacggacactccggtggcggtttcatgtctacagcggctatgctgctttatccggatttctttaaggtagcggtatcttgtgccggcaatcatgacaataacatttataaccggtggtggggagagaaacatcatggggtaaaggagatcacggatgatatgggaaatatctcgttcgatattcgcatcccgaccaatcaggaattggcgaggaatttgaaaggccatctgttattgatccatggcgatatcgataataatgtgcatccggcgaataccattgttgtcgtggacgagttgatcaaggctggcaaacgctttgatatgttgatcgtaccgggaaaacgtcatcattttgatgactataatgagtattattactggcggatggtcgattacttctctgagtatttgagaggcgaacgggaaacaggtgcggatataaaagatttgaaactgggcaattggtttcaggggtatcagtgatgagaagtagtatatgtgagagagattgtttatttttgtctcgcaaaaaaataaataggatgaaacctcttgatataataaagaaatattatccggaaagttcggatgcctaccggattttggtgactcatagccgcagcgtggcggataaggcattagcattggcccgtttgcatccggagatgaatctggatctgacttttattgaggaagcggcgatgttgcatgacatagggatctttttgtgtaacgcaccggatatcgattgccatggggaggccgattatatctgccatggctatctgggagccgatttaatgcggaaagaggggtatcctcgccacgccttagtttgcgagaggcatacgggaacggggctttcgcttgccatgatcgaggaacggaacctgcctgttccacatcgggatatgcgtcccgtgtcattggaagaacaattgatctgtttcgctgataaattctttagcaagactaaattgacgaaagagaaaccggctgataagataaaacagagcttatccaagtatggaaatgagacagttgagcagtttgaacactggtgtaaactctttttaggggaataaaagcataagggctcgtttatttattatacatttgcacgctgtaacacactgcaaagaacgaagtaatgtttttgatatatagagtcctaatcattctattcgttttcctcttgggaggcttgggcgtgcaggcgcaggagattgtcgctcctgccgatagcttggcgcagactgattctctcttggtggctcctacggatagtacaacgttagcgggagattcgattccagaaaagcagaccgggctagatgctccggtcagttatcaagcgaccgattctatcgtgatgacggctggcaactgggcatatctttacggggaaggcgatgtcaaataccagaatatcgagctgcagtccgaattgattgagatgaatatggatagtagcatcgtgttcgctaagtttggactcgactctatcgggcaggagtttggctatccgttgtttaaggagggcgatcagcagtatgagtcgaagacgatgcggtataattttggtaccaagaaaggatatatcacggacgtgattacccagcagggcgaagggtatgttaccgccgggcgaacgaaaaagatggaaggggatatcttgaacatggtgggtggtaagtatacgacctgcgacgagcatgagcatcctcacttttacatccagatgacgaaagcgaaggtgcgcccgaaaaagaatatcgtaacgggtccggtctatctggtcttggaggacgtgccgttgtatccgatcgggttacctttctgtttcttcccgttctcgagtacatattcatccggtattattatgccgactttcggagacgagtctaccagaggtttcttcttgcgtgacggtggatattatttcgccttgagcgattatatggacttggctttgttgggagagatttataccaagggatcttggggattgtcggccaagtcggcttaccgcaaacgttataaattctcgggcagttttaatgcttcttatttggtgacgaaattgggagataagggcttgccagactataatttatccaaggacttcaaggttaactggacgcatacgcaagaccctaaggcgaatccttatctgtctttctcggcgagcgtaaacttctcgacctcttcgtatgaccgtaataatcagaacagtttatacccgaatgcgaatggatatgccgatgtgaaccagaatacgaagagttcatccatcaacgtaacgaaacgtttcccgaataacccgttcacgatctccggtacgatgagtataaaccagacgacccgtgattcttctatcgccgtgaccttgcctagcatgacggttacgatgagtcgtatcttccctttcaagcggaaacatccggtcgggaaggagcgttggtacgagaagatctccatgagttattccggtacgtttagtaatagtataacgacaaaagaaaacttattattcaaatcgaatttgatcaaagattggcagaatgctatgcagcactcgattccggtaagcgctacattctccgtgctcaagtacttgaatatttctccctctttcaattataaggaacgttggtacaccagcaagatcgaacaggaatatgatacgcagaaacaggctttggtagcccgcgacactacgtatggtttttatcgtatttacgattttaacgcttctatctctgcgtctactaccttgtatggtttttataaaccgttgccattcttgggtaataaggttgagatgatccgtcaccgcttcgagccgtctattacggtaagcgcccagccggacttcgcttcttctcgttttggtttttatgagacttatgtatatcaagacgcgaatggtgaggatcgtgaatatacgtattctccgttcgctcataatatgtatggcgttccgggaacgggaaaacaaggaaatatcagttttgacgtaaataacaatatcgagatgaaggtgcgttcggataaggactctactggattcaagaaaattagtctgatcgataagctgtcgttaggcatgagttataatatggcggcggattcatttaagtggagtgacttgagtgtcggtttacgtttgaaattatccaagagttatacgttgaacttgaatggtcagttcgatacctatacgtacgatgagaatgggcatcgtgtcgatattccccgttggaaagcaggcaagggtattggccgtttgagagggactagcaccagtttttcttatacatttaataatgatacgttcaagaagttgtttggaggaggtgatagctcatcggataaatccgggaatcaatcggcttccacggatccgaatgcagatccggatggattgaacccggatggagaaggagagggcgagaataaggaaagtggtggccgtctgttgggcaaaaagaaagagaccggtgagacagatgccgatggctatttaatttccaagattccttggagcctctcgtttagttatggtttgagcttgcggtatggtgattttaatcgttctaaactggagtatgattacgccttgactcactctttgagctttaacggaaatatccagccgacaaagaactggcgttttaactttaacgctacttatgattttgacgctaagaagatttcttatatgacttgtaacgtaactcgtaacttgcactgttggcaaatgacggctagtttcgttccggtcggtccttataaatcctatacattcagtatcgctgtaagctctgctttattgaaagatttgaagtatgataagagaagtaattatagggatggacagcagtggtattaataattgaaaattgagaattgagaattgaaaattaaagttacataatccaataattctcaattctcaatttttaattctcgccccatttgatgggggtttgcccagttgcgattaaataatcattggctttgctgaaatgcttgtttccgaagaatccccggtaagcggaaagtggggacggatgagctgatttaagaaccagattacgggatgaatcgatgaaagcacctttcctttgtgcgtaggaaccccataatatgtaaacgatatggcttctttcagccgccagacgatgaataacagcatcagtaaaggtctcccaacctctattttgatgggaaccggcttgatgcgctcgtactgtgagagtggcatttagcaataatacgccttgatctgcccaacgaatcaaattgccagttgttggaaccggatgccctagatcatcttgtatttctttgaatatattgatgagggaaggggggaaaggtaccccatcctgcacggagaaacaaagtccgtgcgcctgtcccggctcgtgataaggatcttggccgaggataacgaccttcactttatcgaacgggcagtgctcaaaagcgttgaacatataaggaccgggaggataaacagtaccttggcggtattcttgtttaacgaaatcggtcaattgcttgaaataatctttttcaaactcgtcggctaaccgttttttccagctttcttcaatctttacatccataatataatagttggctgttaactaaataagcatcattccagccgcacgtgcttccttgcgcatctcctccggccagatacttgcctgtatctctccgatatgggccttacgaagatagaacatacacaaccggctttgtccgataccaccgccgatactttgcggaagttcaccgctcaagaggcgtttgtggaaatatagttcctttttctccccggctttgcaaatatccaactggcgtagcaaggcttccttattgacgcggatacccatagaggatagttccatagaacggtttagtacatcatcccaaaccaataaatccccgttcaatccggtttgtccgttctcggcgatcgtagaccaatcatcgtagtccggagcacgtccgtcatgcttctccccattgcttagcgagcatccgataccgataatgaatacggccccgtattccttggtgatagcgtcttcccgctctttcggtgtaaaggtaggatatttttgtaacaaatcctcggaatggatgaaatgaatctgttgggggagcgtcgggcggatttgaggaaacatctcgtaaactaaatattcggtacggaccatagcggcatatatgcgacggacgatttccttgaggaaatcgatattacgttcgctttcgctcattacacgttcccagtcccattggtccacgtataaagagtgtaaattacctagctcctcgtctgagcggatggcgttcatgtcggtgtaaataccgtaaccttcttcaatgtgataatcggcgagtgtcagtcgtttccatttggcgagtgagtgtacgatctctgctttagagtcgtttaaatccttgataggaaaagtgacggctcgctcggtcccgttaagatcatcattgatacccatgcccttaagtacgaataaaggtgcggttacgcgccttaggcgtagctcggatgagaggttttgctggaaaaagtccttgatcttcttgattcccatttcagtctgggataagttaagtaaggctttataccctgcgggtttaataagataactcatatacttgttgtactttgtgtttgtgaaatatgtgcggcaaagataatgattaatggcaaaataacaagaatgtgatcgcttttatttgcaaaatggcagaataagcagaatacttatatgcaaaatatcaaaaataaaatatttctttcctgtatttgctaaactaagatattatatgtacttttgcgcagtctttggctcggtagcttagttgaatagagcgtcagattccggttctgaaggtcgtgggtttgagtcccacccgggtcacaaaaaatccttggtaatcaattgattactgaggattttttctttttatgactctttgataaggctccaattctgtgcagattctactaatatagcttagttgttgacctattgttgacccctaaattgtagaattaaaatgttgacaatcaaggcagaagtccaaagggacaaacagagaaatgacggaagttacaatgtgaagattcgttttacttatgagagaaaggttagaaggctgtcttcaagtctgttcgtaacagctaaagatcttactaagtccttatcctttaaagatggtactcccatcaaaagggagattgatgatctggttcgttattatcaggacaagtgtgctcactttcaaatagaatcgaagtgttacactttagatgaaattattaattgtttagacgaggaacgtgagaggaataggagtgtagattttattcagtttgctagagagtggattgcaaatacagaagttaaaggagtaaagaactacaaaagtgctgtgaataccctaattcgttatgtcaataaagaacatctgaatgtgaatgatattactgtaaccttcttaaatggattcattaaatttttaaataaagagagggaggctagaatcgaggtattacgttgttctggtaaacgaataccttctaacagatcagcttctctttatataagtagtgttaggcatttgtttaatgaggctaagaggttttataatgattatgacaggaatatcatcctcatacctaattctccttttgaaaattttaaagtaccaaagcaagaagttacacgtaagagagctattacccctgttttattaaagaagatatgggaattgccctataggtacacggttaaaggtaatgaggcgatttgccgttataatttagcgaaagattgttttatgctttcattttgtttaataggaatgaattccgtggacttatttaatgctgctacaaggattgaagatacaatagtttacaatagaacgaagacaaaggcacgtagagatgatgatgctaagatgatggttgatattcctataattattagatctatagtaaataaatatagtgattgtactggcaaacgactattcaatttttatttaaactatgcggatgaatcaacttttaataaagccatcaattgtgggttgaaggaattggggaaggaattaggtgttgaagatttggaattttatgcggcccgtcactcttgggctactatagccctgaataaggtaggcatagataaatatactgtgcatgcagcgttgaatcatcttgatgaaagcatgaaggttacagatatctacatcgagcgtgacttcgtaaatgaaaataaagctaatttgaaagtgatagaatatgttttgggttgatggataaggtaaatccccacttgcagtaatgtaggtggggataacttgtctatctttgttgtcctaacgtttatattaatggaattaacagaagataaattagaatacattgctttcgttgcaagaagaatattgttgatggcagattgatttacaccagacataagaccggtaagttaatcaaagctcccttgcaaccgcaggccgtggatctgatcgagaaatacagtatcaaagacaatacttacctgttccctattctatctaattttcacaagactgaattgcaaagagcgaacagggtacataaggtaatctccaaggtgaacgaacgcttgaaagagattggcaaggcattggatattccaattgaccttacgacctatgtcgcacgccacagttaagcaaccgtaatgaaaagggctggtgtgcctacctcaatcattcgtgagttgatggggcatagttcagaaagcgtaactcaaatctatctggatagcttcgacaatgaacagatggacgaggcgatgaggaattagctctaaattatcatggattagcttgcttatctcgaaattcttcatacatttgccccaatcttacaaacgaggtaagggaaaaggattaagaacaaggaataatctcctgttcatcacatggcctacgtgacagtgcagtatcaaaaacgataccaagaaagatggccttctacaagaagcctaacagcaataattctaccataggtagcggcttctgcaactaagttaccgggatatacttcccgcacttacgttagacatattactcttgcatctttatacatggatgtaatgtgtctatttgtaactataacttagtcgcaggagctttttttgtcttcaatccaattgttaaacattcaaacttcgattaaatgaacaagaagtttctgttttcccggacaattggcatgagctacctatcgggacttaccagcaaggtaagagtaatccggctcgcagagttaataacaatatatgcgtctgcatccccaattccgggagaggtacgaaatccgtaccgaccatatataagcgattttactcaagtttcttacccattaatcccgtcttgccatgagtgaacagaatggatttaaagggttggaggttgtcgaactgaacatttccaaaggcgaatacctgtcagaagccttaaaaagacaaggctaccccatgctgccgagcaatgccattattaataaggtaatgacaggtacgggagctacttacatggaattgaacgcgaagttaagtccaagaaactctatcgtgattgagccgttcaaatcttcggtggagaacaaggtactgacctttaatgaagctcaaggggtgttcaaagaagtgaccgtcaagaaactgatcgcttacctcaagaaccccaacatcaagtacaaaaagatcataaccacccccgaagggtttcagagcaaagtcttgaaggtggcaaaggacttgggcttgaatatttataaggagttcttctgcctgttcgatgaatccgagcacttgacagaagatacaggctatcgtagaagcatatccgccccaatgaaggagttcttcaaattcgagggaaaggctgtcgtgtctgccactccgttaaagccgagcaagtacaccttaacactgttcttgcgtcaccaattcaagtgggtagaaattaagcccgactatgactatcgggaggatatgactttgataacaacccgtagcttttacagtcgggtgaagcaggaagtaaaaaggctgttggataacggttctccccatgtgtgcatcttctataagacaacagagggaatctgtagcatcgtggaatcattgctgcatgacggaataataaaagaggacgactacaaggtcttctgctcaaaggacagtgccgacaagctaaagagccgcttcttggaacatagtacggataagctggaacttcctctaagaagggtgaatctgtttacatcgaggttcttcccgtcaatagacatcaatctgaaagaactttgcgatgtgctgatactgtcgaactacgatcatgtgaagcacaccctaatcaatccgttcaccgaagccatccagtgtcaaggcagatttaggcatgtgttccccaacgggaagagatataactctcttacggttatagcttcaattcctaacgagcttgaagttaaacccgaagaagaaatatataaagacatcgaggcgagaatcaaatgttaccgagccattcagcaggaagggataaaagctgatgatcccacatattatgataaggaattaaaacggctacggctgaatgaggtcttaaattccgagcggaacagatttgacaggttctccatagagcaactattacttgacgagcaggtgaaaggatattatctctcacccaatgcacttagacaggcatacgaagatacaggatatttcaatgtggacttccaacccgaagatgaagcggtcggtgaagatgacatttacagaattaaagccgctaaagcgaaggataaataccagcttattgtatccacattagaagcgacaaaagacaatgccgaggcgatacggttcgtccgggcacaatgcgtggaggaagaatggcttatcaacgccttcttcaagttagggaaggaggttatcgaacaacaacagtacggtaagactgcgatcaagaaactattgaaacagaccgaggaggaagaagccctacaacgaagattcagcccggagtttcttcatgatatgatcagagagttcgagtcagaaacaggtaacgatttatatattcccgtaaagaatgtgcttgacaggattggatacctgttggactgttacggaataacctactcccgatatggagacggcaagaaagatgcaatgtgcaagttgtccgaagctctcatcaaggaatatttcgatccgaggcgtagtaaccgggagggtgaggccaaggtcaagtttgttcggtttaaagaggagttgtttaaacggaaggactgtgaggaacatataatacctaatgttctccccggttgatcccacccctcatttactccccccatgcttgccagaaggaaaatcaaaattcagacaggcatgggggtacaccatcaatcacaaataaaattatactcaccaaccaactccccaatctccaactgagcgaatctgtaaaaggtaacactaaatagccctatatgtaaaatatcctaatgatataacacttatagtcatttagcaagtagtaatgaagtcctaaattgtaaactgagcgatccgtttcatttaggacttcattcacatacttgccaatcaatcaataatcacttaattcaattacattatgagtacattacagatcatgccgtttgaggcaagagagagaaggtttcagagtttacaatcagcagcggaggaagctactttgctagtgcccaagcacaagaatgtcctacacttcattgagagtaacacgcaggaagcaaccatcaatcacctaaagaacgattgcattgttccagtcttcagcaaggataacgagcttactgtttcacacgctgcattcattgagacagtaggtgaagcagtccagaatttctttagcggtgaacggattgaacaaccagacattcgtgtgtcccatattattaaaggtagagtaccatctgccattcataagcgagcaagccaattacaggatagtgatcgtacgatctactacgagcgttgcgcattcgcttatgaagttccatccattcagtagatcgttgaagggaataagctcaatcttactgttacaggtgtgcgggccttcaacagagagaacctatattcacgtaagacagtggaaaggttcagcattggaattggattcaagaaccttgtttgctgtaacctctgtctgttcacagacggattgaagaacgatattagggttagtgatacgacccagctattcaaagaagcgttagagttgttccagcagtacaacccaagtcgccaccttcaactcatgcgtgaatttggtaatcattcacttacacagcaccaattcgcacagatattgggtaaaatgcgattatatcaaagtctaccttctatcaaccagcgtaaacttccacccatgttaatgacggatagtcagattaaccaagtggcaagggcttatgtgaatgatgaaaatttctacggatatggcagggaattatcgatgtggcggttctacaacttacttacaggaagtaacaaatcaagctatattgatacttatttggacagagcgttaaacgctactgatattgcacaaggcataacatcagcactgcaaggtgatgatgcttatagatggtttattgattgagagaggaaggggcatctatttacttaggtgtccttccttttgtctaataattaactaattaaacttgcaagtacgtaaataagtacatatatttgcagtaaataaaaggaggacttatgagaacagctaattatactgatttaagagcaaatcttaaaggttatattgactctgtaattgatgattgtgaaactgtaatcgtcaaccgtggtaagggaagcggagtagtgatgatttcccttgatgaatacaattcattaaaggagacagaatatatcatgtcgtcacctgacacaatgggcgctattcgtaaaggagaggaagatattaagaatggtaatgccatcgcccagaatgaaggagaaagcattgatgatttcttaaatcgggtagcatgtacagaataatattgtcagaccaagcacgtaaggattatcaatacttcttacgaagtggcaatacagctatcatagataaaattaaagctttattgaatgatatagctgaacacccttatgctgggattggaaaacctgaacctcttaaatatgagttggcaggtaaatggtcaagacggattaattcagagcaccgtctcatttactctgtacatgacgatatgatagaggtctccatcttctcaatgagacaccattactccaagaagtagtaccactacatacaatttactaattgaaagggcatctattaagttaggtgtcctttctttatatctactaactatttaaagattacatcttatgaataccaaagacattgataatgcgattaatcacattatatcattacaggaaaagctatccacctgtgagaacaatctccaatacatcaagcggttgcaagcattgaaatactggctgcataagtttgacagtttattggatagaaccagcagactaaatggtgaatatgcagcgatacatgaaagttacttccatgcctgtgctggattttcattctatgacagggtttatcattccatcttatcataccaatatggagatagaccgttctaattcagttgggcatcctcatttgggtgtccaacttacataagctgaacgaacattcagcgtttgtaacccactattaataaatgtaaattatgaagacatacatagcatatttaaggcaatccaccatgaagcaacagctatcaggtttaggtgtggaagcccaaagagaaatcatacataaccatgtaaagaataaacccatacttgctgaatacattgaaacggagagcggcaagaagtctaacagacctcaacttctcgcagctttggcaatgtgcaggaagactaactctgttctgattgtcgctaaactggataggttgtcaaggaacgtagcatttacatctaaacttctggaatcagatgttgagattgtcttctgtgactttccacaagctaataggctaattctacatattatatcatccatcgcagaatacgaagcggggttaattagtcagagaaccaagtaatcattacaggctaagaaagcaagaggaatcaagttaggaaagtctgataacttgatgaacaagtttgagcaagctatctacaatagctcccgtaccaataaggctaaagctgaaaacaatcccaataatatgagggcaatcgcattgctacggtcactgtcaatgcagggtaagtcactctctgaaatgactgacttgttgaatgagcaaggcttcgtaacatctaagggctgccaattccagataacccaagttaagaggttacttgtcagagtagggttaatatcgtgaaatcactttgaaaggtaggacaaatccagagcaaggttagctttatataccccaatctaagtttgtcctaccctaaatttcaaacggagaagtaagcatctacaccttatatatatggtacatctaaaatattaagttgagaagcatctaaaatcaattcttcacagtttggcatttcagccctatactatatagtcaattacaccaattccaagaatccatatacatctaaagtcttaaaacttatgtcgaagatagcccattgtaaatcaccaacaatatgttgacatgatgatgaaaattcaaggcgggtatggaagttgagaatttgactcttatatggggagagtaagatttcatacctgtcccagatatatgactttaggcttatctctgatttttaatgaacaatagttcttgccaattcaaacgatttagtaactttgcattgtaatccttcactcctaaagcgttaggtcactgaacggaggacattataagttaacagagcgtactgaaattaacccattgtgaaactggacatttctatgattggagttaatgagcaagagcgctcacgtcaatgttatatacctatctcataaggtagtctatatatcgtttggcgtgggctattgtttattatccaatcagggcagtccagaactcttagaaataagagtgcctcacaatggtaatattcaatagtttccacgccttctttgtgtttaatagcttactgaagggaacaggtaagtaactttaaatttaaccttatggggttgttcacactagtagacaggatttccttactccgtgattgtagagccattatgaagctgatggtgaaattgcaaaggtgtcctaagccagacaaggcggaactgtgtcttgaagtagaaagaaggttacagaccttatcaagtaaaggggctaagatgccagatgcggcatttactattatcatacctattcaaggcagggataataacctattttctttcatgcaagtggtgaaggaagaactatattcattcaagaattaacaattagtcaaagttaaacagacgtggcaacaattaaatgttgtagttcctcacgttcttacatttaatagcttaccagagggaataggtgagcatgattttaatatctaaaaagaaatattatgtttgaatactactacattacaatcgtaaaagagaacgcgaagctagctattaagatgaagattttgacatatcaaggagaaagatatgtagagacctcacgtttaagacctaatttacccaacatcaaccaagaggcagctactacaataagtgaattttataatgacattgatttccaagttgcaagaattaactcccaagattgggcattggatgctactagctttgatgatgcattatatcatgcgatagataatcacattagaatacataatcgtttatttgttaacgacttattagcatatatagatgttaattttcatatcttagaagcttgcaacgcctttaatgaagagcaattaagaaacatatactctattagaaaaaataaagctacaaataaatacttaaaatacataatacatacgattgataaataataaatgttcaaaacaccttatacatatcaacaatgtttatccacatatcttatatggatagcatcctgcatagataaagaacagaaggattactatcaagagtgtacaagttttgaaatttggtacgataggcataggggaaatagaattcagataatcttctttaagaaccatgaagattatctttatatactggaacattcaacatttgcatggagagttgacgtacactatcaattctgtagaatatatcgttatcctttaggatgtacgagagaacaaattattgatataataattaaagcgattatcaatatttacaagaacggagatatccctaaaacaatataaattaattaataatatacaatgaataatttagatttattctggaattggttcaatgcagactgtgaagacatgggcattcaatatacccagacggagcaacagaccaataataatatcttgataaagatagtacctacaacaatgtcaagtggtttatatcagctcaatctatttcttaaaagtgatagagttccatttgcagttaaatgctatgggcatcacgagtacattgaatctttactaaatacaacatctacatttagacgatattatggaattcctatactttctatcacggtagattccgatgaatatccaagagaactaactattactttttagactggtgaattaacgacagttgaaattaagtaaattatagatacatataattaaaatttaaaagaatgagaacatttagaattttagcagcccttatgatggctgttgtgtgtgtgggtctatcatcttgtagcaaggatgatgatgagaaaattggttcaacggataatatagttggagtttggactatcacttctgatgaaggatgggaacttcatgagggtgaaaaagatgaatggaaagatgaagattcagaccactttcttaagttttataaagatggtactggaactcatgcggatgaccaagagtttaatccgttcacatggtacatagacaataatattttgactctcaatcctacaacatcatattatgatgaagaggtttggactataaaatcattaaatgctaatacattagtacttgaaatgtctggtacagacttctacaacaaactgacttgtaaaaagaaataaagtttagacattacaaagaaggctgcattgattactctttgcagcctttcttaattaatctcacacaaacatcttaggttgagagctaatcagatatactaattgactaactgattaattactacaaatttagtcaattcaaagtagtccaccaaactaaatatcatacgatattaagctaaatcagactgtctgacagaggattagattgaagacatagaattgaaccaaccggtgtgaagtgggctgttaatggctaaatggcatgaggtgcagaattactaaatattagttcatatatgggatgaatggatttcatacctctttaaagaattgtgtttgagagaactcttatgcagtttcttatactctctcttcactattacagtaatacagaccaaagattaatacactatgcaagatttcacaaccagacttgaagatacttcttacgaattaatgctatttacatatgacacgatctgaattacctaacaattcactcaagacagattctctaacccctaatgctccgtttcattatgtcgtagctggaagccaaggtattatgttagcagcagctacaatgctactcctatatatcattatagttgtggtaggattgatatgtggtttgggatggggaagtttactcttgccaattcttgtttaccatctactattaggtatcgctgtggctgcgttatggacttataataagctcatttcatagtgtgtgaattagagtatcctacatattaatctctacttgtacagtctaatttacattggttgatttcgttatgagtggaatatttagtaaatttgcatcatagttcaatgttgacctatagttgacctctgaacttatatagagataattaaagtgttgataacaaggtagcttagtgaatggagcgtcagattccggttctgaaggtcgtgggtttgagtcccacccgggtcacgaaggaaaggaagtctctttgattgaaaaatcaagggggcttttttagtttagccccgattataaacggatatttactgaactaaccctaacttgattttgttttataatcaaaaagacagaatgataagattaaaaacagaagagtatgtcagtaatttacaaatttctttttccaatgaagccggatggaacggctatttcattactattgttggcgcttcgtttgcttttcggtggattactattatctcatgggatgcaaaagtggacaaatttcgatagtatgtcggcctcatttcctgatccgttaggtgtagggcattcaatatctttgggccttgcgatatttggggagcttgcttgttccatcggttttatattcggggccctttatcggcttgcgatgatccccatgatttttaccatgggaatggcttttttcgtcatccatgggaatgacccattttctttgaaagagttagcattcatttatttggtggtttttatcctgatgtatataacgggacccggaaaattctcgttagatcgtctgatagctgttcctctgtctcgaaagcagaagtaagcgtgaatgtgcggttgaggataaataaaaaagtctgttaatcattagattaacagactctattttctgtgggcgttgacggattcgaaccgccgaccctctgcttgtaaggcagatgctctgcccgcgaccctaaccttggcaaggttatgctctaccaactgagctacttccgcatatacaaccgctttgttctcgattgcgagtgcaaaggtagtgatttcattgaaaccaccaagcctttgcgttacttttttattggatttttttgaccaattccgtaaatagttgtgtcataacagatgctgctttattagccgctacgataacatcggcaccatcatttacaaagtcgtcagcgaagtgataaccttcgttcgtgatgacagacataccgaatacacgcaagcccgcatgacgtgccacgattacttccggtaccgtactcatgccgatcgcatctcccccgacttttccatagaaagcgtactcggaaggagtctcgaaggaagggcctgtcaaacctacatatacacctttctttaacgggatagatcgggaggcggctatttcttccacatagcggataaattcacgatcataagcacgggtcatatccgggaaacgagtgccgaaatcctcattgttcggaccgatcagcgggttcggcatcatattgatatgatcccggatgatcatcagatcacctaccttgaacgtattattgatacctccggcggcgttcgagaccaaaaggttcttgattcctaagagcttcattacacgtacgggaaaagtgacctgttgcattgtgtagccctcatagtaatgaaaacggccttgcatagccaagacttgcttatcccctagtttgccacaaataaaattccccttatgcccggtagcggtagatttcataaaatgtgggatctccgcataaggtatcactataggatctgttatttgatcggctaaagagcctaagccactaccaaggataatggcggtctccgggttaccttcgatccggctagctaaataggcggccgcttcccgatattgttcggttttaatcatttccatatttaatcaatttaacgtttcatcaagttataagctatctctgtcgctttctccataatctcgtcctctcccggtaccttcttattctccatcaatattttaccatcacagataacggtatccacgcaactgccgttggcggcgtatacaagatttgagacgaaattgaagttcggggtaaaagcgggggtgttgagatctatcaaacatagatcggctaaatacccttccttgatctgcccggcttttaaaccgaacatagcggctccttccgcagtagcggcttgcagcatctcatttgcggtcaaggcttcgggatcctttcgccaagcttttcctaacagggaagccagcttcatcgcctcgatcatatccaagttattggaagaggaacaaccgtccgttcccaatcccacggtaatacccaattggcgcatttccttaaacttaaaatgaataccggaagccagtttcatgtttgaggccgggttatgtacgactttcacctcgtgatcggccaacatgcgaagctcgtcatcatcgatgtaaattccgtgagcgataatcaaacgtggagaaagcacacctaacttatataaataacgtacaggagtgagtccgaatctatcgagagagtctttcacttccccctctgtctctgctagatgcagatggatcgggatttgatgttccatagcgaaccgatgcgcccatttcagaagctcaccggaaacggtatagatggcgtgcggcccgatcgagaagcgaacccgtttgctgtagttatccacatcttggatcagtcgctcgttatggcgtttgcatttctccgcctcttctttatcaaaaccatcgaagcaaacgccggctatgatacctcgcaatcccatctcctccgtcacatcggccgtgacacgagggcgttgatacatgtcgaagaaagtggtcgtgccactttttatcatttccaagcacgctaatttcgctccccaatatacatcctcacgggtcattttcgcctcattcggccagatcttttgctcaagccatggcataagcggcatatcatcgccgaagccgcggaacaaagtcatggcagcatgtgtatgagcgttcacgaaaccgggaatgacggctttacggctaccatccagtatcttatcggcaggaaaagacaagccctctcctatttgcttgatctcttttccttcgatatagatatcaatcgtcctatcgttaaacaggacattctttattaatatactcatcttcttccttcttatttatataaacggtagaattccgctaccgactcgattcccttgaagaagatatccaactcctgactctcgttgggcgaatggatcgcgttttgctccaagccgaatcccatcagtacggtcttgatacctaatacctgctcgaatgtagagataataggaatgctacctccgcgacgaaccgccaacggtttcttcccgaatgcgatgccaacagccttttctgccgcttgataagctggcaagtctatcggacaaacatatccttgcccgccatggctgggcgtaactttcactttaacataaggtggggtcacacgagctatatactcctcaaacatttgggagatcttggcatgatcttggtgtggaaccaaacgagtggaaaccttggcataagcctttgaaggcaatacagttttgcttccttcccccgtatatccgccccaaataccacagatatcgaaagaaggccgacaactattacgttctagcgtagaatagcctttctctccgaaaagagcgtctaccccgatcgctttcttatatttttcctcgtcgaatgggatttgggcgatcatctcccgttctgcgggagatacatcctccacgtcgtcataaaaacccgggatcgtgatgcgtccatccacgtcggtgatatctgccatcaatttgcaaagtacattgatcggattcgctacggctccgccaaaatgaccggaatgcaaatcgcggttcggtccggttacttctatttcccagtaagccaaaccacgtaagcctgtcgtgagcgacggtgtttcagcgctgaccatgcttgtatcggaaacgaggattacatccgctttcaataattctttatgttcccggcaaaaatcttccaagctaggagaacctatctcctcctctccttcgaaaataaacttcacgttacactgtaacaagccttctttaatcgctgtctcaaaaccttttacttgaatcataccctgtcccttatcatcgtctgctccacgggcccaaatgcgtccgtcccggatcaccggctcgaaaggttcactcttccacaattccaaaggttcggcgggcatcacgtcgtaatgagcgtaaaccaatacggtcggagcattgggagataccattttctcggcgtatacgacaggattgcctttcgtaggcattacctcggccttatccgcaccagaagacaacagcacctcagtccaacgctgggcacatgtcaacatgtccggcttattctcatgcttggcgctgattgacggaatgcggattaaagagaacaattcctcaagaaaacgatccttattggattcgatataagattttactgacatagcgttttattttatcaagtttataaattgtagcaaatataacgaaacagatggggattgcaaggagttttatggtattttagccgtgttactacaataggcgtgcagtaacacggcaaggcgggttgcagtatacgaaagagtttcatcccatgatccatttagctcgttcacctaatatacggtacatgaaccaagtaaacgcccatgagattatgaaaatcaaaagtgccattatgggtacttgcaaaggtatcggtaaatcaaacttcccgatcaagataaagatcggacctacgacaaaataatgtacgatatagattccgaaaccatatttggatattttcgatagttttttagctatgagagtattatgaatacgtaccttttgaagaagaataaatacagctgccgtcattaagactacattcggactacagaaggtgaaaaataactccatatccaattctgttgcctcgggattcgctgcggccgaactgaatccacaataggttatggcataaccaaccacaaacatggctgcgcaaatagcgaaggttttccaaatattccaattattaccttgttttaagtaatgtcctaataggagatatccgttgaatcctgcgaaataataaaacatgccgaattgattccacgtcgcttccccgtataaatatttgctgatataggcagacatataaggcaagaaaagagatacgaaccatatccctaaatagaccctctctttggaacgatccgccttctcgatccatgcggagaagaatggcatatacagatacaatccgatgagtaaataaatataccacatatggttttccttaaaactgaaattgaacgggatcatggcgatgtctttcaatgcgtcggataaggattgtgactcatttccttgcacatagcagaaaaactcaccgattatctctttcggcaaacctaatagccctgtaacccaagggaatatattgtataatacagaccatatcaaaaaaggaaataataccctatatattctctttttatagaaaacacctaaagattgttcccgtataggcaatagtaaaagtcccgtcatcataacgaaaagaggaacggagggccgtaaaagagagccgtaaacagcggcccaatgtttatattccggtaaacttccgagtgtaggtgagatataaaaaggatctatacaatgtactccgataaccatcagcatagctacggttcgtattacatcgagccacacgatatgtgactgtgttgttgcgttgttcatggatttatgtgttaaatttaaaagatgggtgacaaagatagagcttagtatgagaattttgtttatctttattgttaatttattgtattaagtattatggtcaaacgaattatcattatcggcgctacctccggtatcggctatgaggttgctaagatttattggaaacgaggatatcaactgggattggctggtcgtcgggttgatcggttggaggagtttcgtaagcaagatccggagcatatccagataaagcagttggacgtgaccgccgaggatgccgctgatcgtttagacgaattaatccgtgatttgggaggaatggacatcttcctgcttagttcagggatcggcaaccagaataaatacttagatacttccattgaacaagctacgatacagacgaatgtgacaggctttacatgtatggtactagcggcctatcgttatttttccagtcaaggtggcgggcatatatctgtaatcagctctattgccggaaccaaaggattaggtgtcgctccctcctactcggctaccaaacgataccaaaatatttatatagacgctttagcccaactttcccgtatggagaaacagcctattacatttacggatatccgtccgggatttgtccgtacggatttattgaaagacggcaggaattatcctatgctgatgtctccccaatacgccgccttgcgtatcgctaacgctatagaccggaaaaagagaagggcgatcatcgattggagatacgctatccttgtctttctctggagactgatccctgaatggctttgggaacggctgccaatacggaattaggatcggatatgttagaggttcatcttttttgcttctacattagattttctcttgtgtcgggagcatgctgaaggaccgcaccgactatctggcaactatccaattcatcacaatcgccacatgtattaaagccttttccggatacacatttgcgtatttcacaataatcactgcaatacgcaaatttcactccgtccgtacgacaccccatacagtttatagttgcggctgtaatttcgggcgcattgttcatggcactccacttttgggcggttttttctcttagctcattatcattcttaactgtggctatgcgggcatcgcaactttcgcaatctaatccgcaacaggctatcaattgtttcattatttagttgtctatttattttcttgtttgtttctgtccttgcttttacttttcggcaaacataataaaaattcctacctttgcgcccaattactaattttttaatctatacagatgggtttatttattaagaagcctttagcggatttgatgaccgaggcaaatgattcgggcagtaaatcgctgaagcgtatccttggcccgtggagtttgatcgccttaggtgtcggtgttattatcggtgccggattgttctccattacgggtgcggtggccgccgggtatacggggcctgccattactttatctttcgctatcgccgccttgggctgttgtttcgccgggttatgttacgccgagttcgcttccatgatcccggtggcaggtagcgcatatacctattcgtatgccacgatgggtgagttggtcgcttggattatcggttgggatttggtgctcgagtattgcgtggccgctacgaccgttagcataagttggagtcggtatttggtcgtttttctggaaggattcggagtacatttaccgcaagccttgacggcttgcccttgggatggcggtatcgtgaatatcccggctttcgtgatcgtggtgttaatgagtattttgttgatacgagggacggaaggaagttctatcttcaatgggattatcgtattcttgaaagtctccgtagtcttggtgttcgtagtcttgggatggaaatatatccgtatggagaattatacgccttatatacccgctaatacggggaccctaggcgagttcggtttctccggtatcctacgaggggcggctatcgtattctttgctttcctcggtttcgacgctgtaagtacggcggcgcaggaaaccaagaacccgaaacggaatatgccgatcgggatcttgatgtcattagtggtttgtactatattatatatgttgtttgcccacgtgatgaccggagtcgtacattactcagcgtttgctggccagaatggaatcgctcctgtggcaatagctatcgatcatatggggcaaatggatgcttctggtgtgattcgtccggattacccttggatgaaccgggcgatcgtaatagctattttactggggtattgctcggttatcatggtaacgttattaggacagagccgtgtattcttgagtatgagccgggatgggctgctccctcccctattttctcatatccatgagaaattccgcacgccggcacgaagtaatttcctgtttatgttattggtcggtgcattggcagctttcgttccggcgagcgtagcgggcgagatgtgtagtatcgggactttgttcgcttttacgctagtttgcgccggggtattgattgtccgtaagacaatgccggacgctccccggtctttcaagaccccgttggttccgttcgtgcctatcgccggtatcataacttgtctggtaatgatgctttttctcccggctgatacatggattcgtttggtattatggatgttaatcggtctggatatatatgtctgctatggaatcaaacatagcaaactggaacatatgcagaaacatcgctcgggacagaccacattggatatgatcggtattaccctatccgtgctttgcgtgatcacggggctttggcaccagcaaaccgtgggatggggcgagagcaaaatcttattgattatctcattcgtattcgcttttacgcatctagctttctatctttacagactcgggaagcagtttacgagccttacccgttagcgattcagcacgattagtctcgatggttcacgcgactagtcccgatggtcaataccagtagtggtgaaggcttatgcgagtagtcgcgttgaccttcaccactactggcgtactataccacttcctttaatacgatttatcggattctagctcttaaaagtaagcctcttattcatcataaaattaacggctccgtaaacgaaaagtccaaggaactgacccagatattcatttagatcgatcacctccaccattaaaagcaagaatatgaattgagtagcgtaagcgcaaccaaaagcgattaggaataaaggaatctccttccagaaattacctttcccggaagaaaatacccagtatttactccaaaagaagttattcaccaaggcagccacatatccagccatgttcgaccacaagtaattacaatccagaatatccattaatatccagattaccaatgcggtgatcaaagcgttagaagaacctacaatggcgaaacgaagaatacgaacagattccttcatgctgttaattatacgtttcgaatgacaaatatacgggtttatttctatatttgtgctgtacttttgatcaagtatgtaacattcttaaaacaattatgagtatgattagactgaatgtatttattcaagtaagtgaggagaatcgtcccgccgcattggagactgcgaaagaattggttgaaaagtctttgaaagacaatggctgtattgcttatgatattttcgagagcgctactcgtagtgatgtattgatgatttgtgagacgtggaaagacgctgaatccttatcagctcacgaaaaagctgagcatttcgtaacgttggttcctaaattgcaaggattaggtgcgatgaaacttgagaaatttacattttaagggttttatgtaggcttattattataagcttgagcatgctaaaaaatcatagttatgaatccttcaacttataactatgaatgaaagaaaacataactatgatttttttagtgttatcgctcgttgattgagatatattccctatcgtccaaaacgttcttgtaagccggacggatgatgcgttttccgtcaaagttcaactcctcgatacggtgagcggtccaacccacgattcgggccatggcgaataaaggcgtatagatttcctgtggcaaaccgatcatctcataaacgaatccggaatagaagtccacgttcgaggaaacccgtttcttagttcctttatgcttggcgaaacattcgatcgctctttcctctaataactcaaggaaggcgaattcctcagagcgacctttctcttttgccagatcacgagccagttcctttaatacaaccgcacggggatcggaaatcgtatagaccgcatggccgataccatagatcaagcctgtcttgttataagcctctttgttaagcatccgcatgaaataagtatcgatctcgtccacgttcttccaatccgcgatattctctttcaaatgatggaacatatctactacctgaatattggcgcctccgtgcaacgggcctttcaatgagccgataccagctgcgatagatgagtacgtatccgttcccgtagaactagtgacgcgtaccgtgaacgtagagttattaccaccaccatgttctgcttgcaataccaagagcaaatccaacgtacgtgcgtccagatccgtgaaatcacgtttcagcatgtgaaggaaattttctgcgatcgataagttctcgtgcggatgacggatgtgtaaagaacgcccctgtgtgctatgacgataaatattgtaggcataagcgataatcgtcgggaacttagagatcaattcaatagattggcgcattaagttatctcgggaggtgtcgtccgggtttgcgtcgaaggtatacatctccaatacgctacgagccaatatattcatgatgttctgtccttccagatccagaatattcatcttggtcttttgctccaagggcatattatcgttcaacagttctttaaaggctgataattcctctttatcggggagtttaccagaaagtaataaataagccacttcctcaaaaccgaaccgtttttccttgatgaaatcacgcgctaaatcctctacgtcgtaacctctatagaataacttaccggggatcgctttaagaccgccctctggcaagcgttcgtatcctactacattaccgacttgggtcaatcctactaacacgccactaccatcctcgttacgaaggccacgtttcacattatacatcgggaaaagttcgttgtcgatcttgcaagcctctctggcagcctcggacaatttgtaaattaaatattctttcttcaacatgactatactaatttaattgtttcgataatagagatgatacgatcaccaaattctttggtgccgagagatttgccgttcggcataaaacgagccaagtcatgagtggcctctccagcggagaaagcttgctccatagcggatgtaatcaggttagccgcatcactccatcccatatattccagcatcatcacggatgataataataaggaagaggggtttacgagattctttcccgcaatattcggagcggttccatgtgttgcctcgaagatcgcatgaccactgttatagttgatattagcaccgggagcaatgccaatgccacctaccatcgccgctaattgatcggagatataatcgccgttcaggttcaaggtagcgatcacggaatattcttccggaattaatagagtgttttgcaagaaagcatcggctatgacatccttgataatgattttaccggcctttgaagcttccactaaggcggtattggccgcttcctcgccttgctctttcttgatcttctcatattgaggccatgtgaaagtgagatccgcaaactcccgttccgctaaagcgtatccccatagtttgaaaccaccttccgtgaatttcatgatgttacctttgtgtaccaaagtcacgctcggtaactgatgcaatatcgcgtattcgatagcggcacgcaccagacgctccgtaccttccacagaaaccggcttgatgccgaaagaggaagtttccgggaaacgtattttcttcactcccatttcctcggtgaggaacttcaataacttttgtgcctccggagtcccttgttgccattcgattccggcatagatatcttccgtattctcacggaagatatacatattcactttctgcggctcctttaccggagatacgactcctttgaaccaacgaaccggacggagacaaacatataaatccaacgtctgacggagggccacatttaatgaacggatacctccaccaattggagttgtcaacggtcccttaataccgacgatgtattcacggaatgcttccatagtctcatcgggaagccaacttccggtttgcttaaacgccttttcgccggctaagacctctttccattcgatggaacgggttccgttgtaagcttgcttgatggcagcgtttactatcttttggctaacgggagtgatctcatgccccacgccatctccttcaatataagggatcgtcacgtgatccggaacgaaaatatgattacctttctttgttatcttactcatgatatcaagattttttgtttgtcttagtgagctgtatttaaagcggaacccgccttgaaccatttaatttgtaaatcattatacgtatggttaaccgggaatgattcttgcgtaccatccgcatgaagaagaacggccgtcaacggtttgcccggctgaaaatctttcaatccgatgatcgagatatggtcattctcgcggatcttgctgtaatcctccttattggcgaaagtcagtgctaacattccttgtttcttcaagtttgtctcgtggatacgggcgaaactcttggctaggatcacttttacatttaggaagcggggctccatggctgcatgttcccgggaagagccttcaccgtagttttcttccgctacgacgatcgaggaaataccatttgccttgtattgtttcgctacggcagaaactgcttcatatttattgttcagttgattcaatacagagtttgtcttcccattgaaagcgtttacggctcccatcaacatattatccgatatattttccaaatgcccacggaaacgtaaccatggaccggccatcgagatatgatccgtcgtacatttaccttcagccttgataagaaggggcatattcgtgaaatcctctccattccaaggagcgaaaggctttaatgcttgtaggcggttggattccggatcgatgttcaccactacgttcttacccgtaggtgccagatagccgttaccctttacctcgaaacctttcggcggaaaatccgtgcctttcggttctttcagtttcacaaccttaccatcctctgtcttcaaggtatcggtcaaaggattgaaacatagatcacctgcgatggtcaaggccagtgtcagttccggagaagcgacaaaagcatgtgtattcggattaccgtccgcacgtttagcgaagttgcgattgaatgaagtaacgatcgaattcttacgggtattatcatccgtatgacgtttccattgtccgatacaaggaccacaggcattcgccataatggttgcaccaatccgttcaaaatcaccgataataccatctctttccgccgtataacggatttgctcggaacccgggttgatgatcaagggtgccgctaccggtattttatcctcataagcttggcgagcaatggatgccgcacggcttagatcttgataagaagagttggtacaggaaccgattaatcccacctccatctttcggggatagccattcgcttttacttttgcggcaaactccgagataggcgtagctgcatccggcgtgaacggaccattgatatgcggctccaattcggaaaggttaataacgattacacgatcgtaaaacttatctggctcggcacgaacgtccatatccgcttccagatattcaccgatagcttcggcccagctcgctacctcgtcacgtcccgtggcacgaagatattgagccattgtattatcgaatgggaataaggaagtagtcgctcctacctcggcacccatattacagatcgtagcttttccggtcgctgagattgaggcggtgcccggaccgaaatattcgatgatagcgttcgttccaccttttacggttaagatgcccgctagcttaagaatcacgtccttcggcgaggcccaaccattcaaactaccagttaacttaacaccaattagtttcggcatcttcagttcccattccattccggtcatgacatccacggcgtcggctcctcctactccgatagcgaccattccaagtcctccggcattcggggtatgtgaatcagttcctaccatcataccgccgggaaacgcataattttccaataccacttgatggataatgcctgctccgggtttccaaaaaccgattccatatttatcggagaccgatttcaagaaatcatagacctcgctattgcttttggtagccgtatcgatatccgtcttggctcccatattcgcttggatcaaatggtcgcaatgcacggtagccggtactgcggatttttcttttccggcgttcatgaattgtaaaagcgccatctgagcggtggcatcttgcatagccacacggtcgggacggaaattcacataatcctcacctcttttgaaaaggcgagtcgagctttcatcgtatagatgcgcatataagattttctcggccaaggtcatcgggcgaccaccgatacgttcgcgggctgtgtccactcttctggggaaattcgcatagaaatttctaagcatgtcaatgtcgtacaccatattcatattcgttttttattgtaagccttttcgcaaatatatttatctataaccagctaaaatgtaataaataagacatctgccaatgagtctttgtttttattatcaacaaatatataatataatgaaatacaatttgttcgataatttctatgaggttatagaggttatttataatctcccggataacttagaaaaacgggctaatcgcacgtttattaataaaacgtaccattagcccgttttgttcaagccttggagctgttttttctacttatcgagactttctttccatctttgggcataactatgcaaaatagatgcgataccctctccgatccggacataatcttcccgtttaaggttagctaaagatgcgcggatagaccactcgggagcatcaaaacctcctccgttcagtaaaaccaaggaagtttcctgtgccagacggaaaacgacatccagaggttcgtaattcttttttagatattccacgaaatcatccccatagaatttcttagcccagacaagcatatcgatctcactataatatcccgcacgcaaagggtcgtctaataaggtgaatccggtgctttcccacaatgtgtgtaaacgctcgtggatcatatcctgcatccttttcttataggtattttccgcatctaatagagcgaaagacgcaaacagagacatttgtgtttgttgtggcaaggaaagaccggccgtatgattcaaggctacttgacggctatcggctaccatacgatcaataaagcggatatcctcgggatgtaaggatagactgctatatcgtttttttagaagctcctgtttatctcttggcaattcacggatcatccggtcgtaaatattatcttgatgtaaagcgattaccgccaatctccatccggttgccccgaaatatttggagaaagaatagacacataacgtattctttggtaattcggccatcatcgagcgaaaatgcggaataaatgtcgcatacacatcatccgtaataatcataaggttgggattgtcgttccgtacgatctcaacgatcctattcatcaatgcttttgtcaatccgtatgaaggcgggttgctcgggtttgttatgaaagcggctttcacgctaggatctttcaggacatctaaatccttttcttgatattgccacgtgtgatagccgtcttttgtcatcttcaaggcttttatctctatgacattaaaaagataacgagcctgttccggaatctctatataaggagtgaataccggagcgaagagaacgatcttgtctcccttattcaacaagaaattctgttgcaaggaatcgaagatataacacatggcggcagttccgccctcggtagcgaaaaggtcgaatattccctcagggggctggttatcacataattcttggtctaaataatcccgcacgagcatttccgtatatttcaagatacgatcgggaaccggatattgatcaccaatgacaccttccgcccattcatatacaagctcattctcatctacacctttttccgtgaccagatattcataggtacccttcaataaagtagcgccgggagattgcgcatgtttctttagaaactgtacgaagcgagacgcgatccttttgcggttgggaacccctgcggctccggccatctcatctgccaattcggtttcccgcaggcattcctccaaggcgaactgccctaataggaagaatgcctcccgtggaaccgtactgatccagtttggatttccccttcctgcgttcagcatgatgtgcgtacttttacgagcgctctcatccgctaactctatcaagatgttctttagctcgaaagggctaatctccgacatctttttctcatattctctcgtgacatgtattttcttcttgtccatacattatatatattacatgattagcacaataacgacaccccagatgattaataaagtattacccaccgcataggtaacggtatagcctaaggctggagtctcacttcctacggcatcttccaccgctcctaatgcggcagttgtcgtacgtgaacccgccgtacaacctaaagtaatagccgggtggaacttaaaaacgtaacgtcccatcagaataccgatgataagcgggatagatgtcgctaaagcaccgataataaataaacttataccgacttccttcaatccggtcacgaaactgggacccgccgtgataccgactacggcgataaacatattcaatcccaaattatttaatatccagacggaaggctccggaatacgcccgaaggtcggatgcttagaacgaagccatccaaagacgagcccggctattaaagcacctccactcgtacttaggctaatcgggacacccccgaaatgaatcgcgagcgaacctaaaattccccctaagaaaataccgatacccacgaaaatcaaatcggtctgattggttgggcgatcgggatatcccaaagccgtcgccgctttatttacctctgatttcatgcctaccaattccagcatatcaccggaatctatcaccgtagcggccaagaccgggatattgatacccgcacgccttacggacttgatgctaacaccatgcatgaacgattgattgcgtaaatagcagatctttttccccacgtattccttatggatcactagtacgggtaacgtctctgccggaaaatcgagcaattcaatgtcattgacctcgtcgccaatccagttctcctctccgatcacgaattcccggcgaccgcttagaacaacctcatttccggtatgtaaaaccaaatccggtttaacatcggttactacattattaatacggacacgctccacgaacaaatgccgtcccaattggtctaaatatacctccaactgctttacgcttttgccatccttgaaccattcattactaatcttataggcccggaaagttaccggacgggcggctggcataaagcccggttgctcgctctcgtcgttatttcccattttagcctctagctctttacacgcttttttcacgtagtcgagtcctcctaaaagacgtggcccgatatcactcactaaccatgcggatcctgccgtaccgaaaatataagttaccgcataggccacgggcattacatttaccatagcgcttttatccgtatcgctaatattcatctgtccgatcgtatcttcggcaactcctaatactgccgacatcgtctgggagcccgccaataatcctgcggcctcgcctgcgttatatcccataagtttcgctaacaaaaaaggagcgatcaaacaaaatatacacatgacggcggcgaaaagcatttgaggaagaccttcctttttcaatccccggaagaactgtggcccaacgctatatcctacagcgaagaggaacatcaagaaaaagacggactttaacggtccgcttatatcgattttcaattgcccgatcaatacaccgaccaataatacgctggtaaccgttcccagcgtgaacttctttatcttaaacttgccaatccagaaaccgagagctaaggttatgaaaatagctagctccggataatgttgaagtaaattagttatccattccatatctatttatttgatgttaaacaaaaaagatgctattgaaacagggattctttgaaagatgttgttacttttcgggattatttatataaatttgcgaccgcttaggtgatagagtttgtctaccgacaactctataaaagggaatccggttagaatccggaacagtgcccgctactgtgaagctcttgaaaaggaaagcgttctgctatgccactgtcttaagaaagatgggaaggttgctttccgagccagtcaggaaacctgccaagcgaagtaatgattaattcctcccggggttaggagtaattaagaggatagaaatatcacctatatctaaaagatgttggagacagaataatacgttgtctccgtgggattgatatgtaatctaattattaatatattcatatgatgaggaaacacttactatctttcttcctgctggtcatcagcctagtttgtcgtgcgcacgatggcgagaattttgtagcatccgatttattcgcctctttacaaccgggcgataaggccgctttattgatggtacattttggaacaacccatgatgatacccgtgccttgacaatcgacgcgatcaatcaaaaagcgaaagaagctttcaaagatgttgagttgcgtgaggcatggacttctcgcattgtaatgcgccgcttaaaagctcgtggcatagagaaactaaacccgatcgaagccttggaaaagttaaaggctgatggttatacgcacatcttgatccaatccacgaatataatcgaaggtatcgagatggaatccttacgtaaagacgttgccgccatgaagtcttctttcaaggaaatccgaatcggcaatcccctattgtatacgccggaagattatgaggcagtaatcgctgctatcataaaaaatggggcgaaggaaggcgctacattattagtaggtcatggcacttatactccagcaacggcccaatatgccatgttggattatatgttgaaggagaaggggctcaagaattattccgtaggaactattgaaggttatccttcttttgatacgatggaagctcaagtaaaagccaatggtacgaagaaagtcctgttaatgccatttatgtttgtcgctggagaccatgcgaaaaacgatatcgccggtgattggaaagaggaactggaaaagaaaggctacgaggtaagcgtatttatggaaggtctgggacagaatccggatattcagaagattttcatcgagcacgcccgttttatggctaaacataagatgattgatatcgtcgacaagaaaaaagcttatgcggtagaaaaagactaatatgctaaatatatgaaaagagttttgacaattttaccgttgacagccttatgtatcagtacgatgcaggcacaacacaagaaagagtacacgaattttgccgatacgacattcaatattcaagaagtcgttgcgaccgccgcacgcaagccacgtccacaaatcacgaagttggacgtacctatgaaatatcttcctatttcaattaatagcattacggcgagtagtttggagttgcgaggtatccgtaatatccaagatgcggtacgctttatgccgggcgtacgattccagacatcttatggcgcatttcaacaattgtcgatccgtggtttcgatcattctatcatgatgatagacggtatccgcgatgaacgttcggcaataaacaactcttatcccgtacccgatctatcctgtatcgagtctattgaattattaaagggaccggcttctgtactttacggacattcagccgtaggtggaaccttgaatatcgttcgtaaatccccgtcagagaaacagagcgttaatgctcgattggcctacggtagttacgagaataaagaggcgacacttggcatgggcggtaaattggtcggtccggtcaattattacgccaatgtcaacttttccgatcaagagggctggcgtgataatggcaaccgtcgcttttccggttatctggcattgcaagctaaaatgacggaacgtgacatattagatgttcgcggaggttttaaccgcgacttctatgggacggagatcggtcttcccgatttaatggcaaatgatgtatataatgtgcaaacaggacagttatatctccataaaaatgagatgctaccgggacttgaccgtgaggctcgctacaataacgagtccgactttatgaagaatcacgcatggaacgtatcgacgcaatacacacatactttttggaacggcgcgaaactaacagatcgcctttcttacaataacgacgatatcaactattttgggacggaagccctcgactatctcgaaagtgatgatccgatctatgatcattattatatgaaaaacggccagaaaaaatatatctgtttggacagtgtatatctttctttcccgcttcgcttctcccatatagccaagacggtagccaatacgctcgagctaagcggtaaattcaggacgggtgagataaagcatacgtatatgggaggttactctttcgtcgccttgaatcgtaccagctattcgggctataatttaggagatgatgttcagggtcccggcctttattcgcatgtatccgtttatgatccgcatagcatgggatatatgaccagtaaattctcgaaagcaacggttacgcatcattattccaacagcctttatcttcaagatatggttgagttcaacgagcaatggaaggtattagccgctctacgttacgactttttccgttatatgtccgccagcgctacaactcctaccggacgacgtgagtatgaggagcattcaagcttcaatatgataaagaataaggcgttgacttatcgtttcggagcggtctatctgccccatccgaatacatccatttatgcgtctttcgcctctttcttcaagccgatccgtacgttctatcaagataacgtcatttatgtaggaggtgatggaaatcgtttcgagcctgctcgcaatgaggaagtatttaagccggagaaaggataccaagccgaggtgggtcttaaatatcaattgaacaatatattaagcgccaatgccagcttgttctatatccggaagatgaacagtacggctacgttgaccaacaactatcaagaggaagtaaacggcgagactaccacgatgagtgtaatcggacaggtgggtgtacaagattccaaaggttttgattttgatgtcactctttctccggtaagcaccttagcgctgacgatcggttatggattgaacgactccaagatccgggagatgaaagaaataaaggatccggaattgatcgaggctatctatggcaataacccggatgagacaaagcaacaattgaatagccaagaaggaaactggcagagcaacgtaccgaaccagactttctacgcatacggcagttataccatccctcggggtgtcttgaagaatctggaatttcacttgagtagcagttataccggtaaagtataccgtaatacatctaacaactcttggttcgatccgtattgggtaaccgatttcggtatgtcttatttgttgaacaacaatattcaccttacattcaacttgaataacttgtttgacaacaattattataaccaagcgctcggacaacagatggtgccaagcatgcctcgtaatttccaagtggctatctcctatacattataatatatagaacatacgctcatgaatctattgacaaagatcacgctatttatacacaggatactgggcacggcgttcagtatcctgtttctcgtttggttcctatcgggattggtaatgatctaccatacgttcccgcgagcggaccgggccgataaacgggcgaagatggatattctctctctggagaatcttccttcgttagaccagatagagaaacgtttaccgcagaacgagcggataagccatgttaccttaaacagctatttgggacaaactgtttttcatatccggacggagaaagggagctatgatattcctgccgactcgacggaaagattacccgtaatcgactggaatcgtatccaacgtgtggcatcacaatggaatacctcttccatagcgaaggtagattccttgtacaccttggaccaatggattccattcggtcgtttaaaagaggaatttccgatctataaattccatttcgccgatccagaacgacatgaattatacatatcctctaaatccggggaggttttgcaatatacggataaaaacagtcgtttctgggcttggctcggggcgatccctcattgggtttatttcacttccttgcggcaagacgctgaattatggataaaggtagttgtctggttatccggcattggatgcgttatgtgtatcgctgggatctatttaggaatacgggatttccggttagcgaggagacgtcatttgatttccccttataagaagttctggtataaatggcatcatattcttggggtgttattcggtttattcgtcctcaccttctgctttagtggtatgatgtctttggctcgtgtacaggattgggggttgaaagccaagcttgatataaacccggttcaagaactgcggaagatggctccttccccactcgattatccgttggattacagggcggtcatacaagcctatcccggccagatccgtcaattggaatggagcagttttggtgatatacccttttacatcgtacaaacagacacgaaggatattgtcgtgaacgcaaataagagtgacgggatatctttattgaacctgcgaccggaagaaatccgttccgtattgtctcagatacatggtatcgggaccacggctgatatcaaactgttggatgcttatgatacgtattatatctcacgaaaaaggaatttagaactcccggtctggaaagtatctattcaagacgtggataatagttgttattacattaatccccgtaatggacaataccgttatgtaaatacgccgtctcgttggaaccattggatgtatccggcattgcatagcttgaatctgaaattcttggtagatcatccggtcttatggaatatcgtgatgtggggaaccatgttgggaggcacgttcgtttccttatccggtgtatggcttgcgataaaatatatcaggcgaaaagcgagaagaaagaagtaaagcctgtatatttgtattatatttattgagaacattgtattataaaatagatttgaatgaataaaggcaagattatagtcgccggaatcggccccggtagcgaggccgatataacgcctgcggttttggccgctatccaaagctcggatgtcatcataggatataaatattatttccgttttatcacccacttgcttcgtgagggaacggaatgtatagatacaggtatgaaacgtgagcaagctcgtgccgagcaagctttcgcttatgccaacgagggaaagacggtttgcgtgatcagttccggtgacgccggtatttatggcatgactcctctgatttatgagatgaagaaagaatccggaagcgagatcgagatcgagtcgtatccgggcatcagcgctttccagaaagctgcgtccttgcttggcgctcctatcggacatgatttctgtgtgatttccctctcagacttgatgactccttgggaactgatcgagaaacggattcacgcggcggccatggccgattttgttacggcgatctataatccaaaaagcgagggacgttattggcaactctatcgcttaaaagaattgttcctgcaagaacgcaagccggagactccggtcggttatgtacgtcaggccggacgggaggagcaagaagtattcgtcactacgcttgcggatctggaccccgagcagatcgatatgtttacggtagtcttgatcggaaactcacagacatatctttccgggaatcatatgatcactccccggggatattatggagagatcaaacaaaagaaaacggatacgggtatcggacaggacatcatgatccgtagtttccgtacgatcgagaaggaattgaaaaaccaagagatcccgttggataagaaatgggcgttactccatgccattcatacgacggccgatttcgatatggaaaacatcctttataccgacccggatgctgtctctacattatataataagatcagcggcggggaagttcctacgatcatcaccgatgtcacgatggctgcttccggcattcgtaagggagctttgcgacgtctgggtgtcgaggtgaaatgctaccttcaagacgagcgggtcgctgagatcgcttcgagcaaaggaattacccgtacccaagccggtattcgtcgggccgtggaagagcatccgaccgctctgtttgtcttcgggaacgccccgaccgcccttatggaattatgcgatttaatacgtaaaggtaaagccactccagctggcattatcgcggctccggtaggtttcgtacatgtgcaggaatccaaacatatggtgaaaccttttatcggtataccgaaactaatcgtggaaggtcgtaaaggaggtagtaatttagcggctacgctagtgaatgccatcctttgttttaatgacgcagaacaattaaagccgggaagagacgtatgaaccgattttatgtcatagggctggatgataatatgcggcaatactttccgccggagatattggagataatctcgtcccaccgggtgttctccggaggcgtgcggcatcatgagatcgtacgctcgctcttgcccgagaaagcggactggatcgatataaaagtcccgttggacgaggtcttcgatcgctatcgttcgtacgacggtcgggaaagcatcgttgtattcgcttccggagatcctttgtttttcggattcgccgttacgattcaaaaccgattgccggatgcgcaaatccgcctgtacccgtcatttaattccttgcaactcttggcacaaaatctattgatgccttaccacgatatgcggatcgtctcccttaccggacggccttggcacgagttcgatcgtgccttgatcgaaagtgcgtctaagataggcgtgctcacggatcgggaacatacgcctacgactatcgctcgccggatgctggaatacggctatgataattataccatgttcgtgggagaacggttaggaaataccgaacggcagagcatccgccaattcagtatacaagctgcggcaatgaataatttcgttcatccgaattgcttgattctccggaaagagcgtgacgggcattcccgtaagttcggcctgccggattccgcgttcgagcatttgaacggacgggagaagatgataaccaaaatgccgatccgtttgttatctttaagcatgctggatctgagagatcgggaacatttttgggatatcggcttttgcacgggttctgtctcgatagaggctaaattgctgttcccgcatttgcatatcacgagttttgagatccgggaagagggacgaaagttaatgactgagaattgtcatcgttttgggactccgggtatcgaggctataatcggagatttcttatcggtggatttatcagcgctggaggctccggatgcaatctttatcggtggacatggcgggaaattagtggagatccttatggtagtttccaaaaagatgaaagagaacggtgtcatcgtcttcaactccgtatccgacgaaagcaaagcgcttttagaggaagcggtccgccaaaccggtcttcggatatccgcccaaacccgtatcacgattgatgattttaatacgattaccgtgaatgttatttataaattatgagtacaatatcaattattccaatatccgatagcagccgggtgcttgctgagcgaattcttgcttcttatcccgaggcgaagatcttaccattcggctctttctcaaaagaggtttttcacgaatccagtagtttggtatttataggagcgatgggaatttgcgtacgcagtatcgctcccttcgcggaagataaacataccgatccggccgtggtttgtatagatagtaccggcaaatacgtgattcctgtcttatccggacatatcggtggagcgaacgatctttccaaagagttagcgaacctattaggagccgaagcgattattacgacacaaagcgacaacgcaaacctatgggcgctcgatacattagggaagaaatacgattggaccttgatcgccaaagatagcaatgccgccatctccacttttgtcaatggaaaaccgacagcgctactccttgatatacgagataaaggaacggattatttggagcgtacggtcccgtctcatgtctctatcttttattccttcgaggcgataccgcagcaagactatgagttattgatgatcgtcagtccccaacaatacgatacatccatccctacgatcacctatataccgaaagtcctccacctaggaatgggttgccgcaaggatatgcaaggcgatcctacggtcgtttacgaacatattaaagatgtattgcgtgataaacgcctatatccggaagctttggcggatgtaaatacaatcgatttgaagaaatgcgaaccggtgctgacattattggcttatggagttatggaatgccctttccacacctatacatcggaggagctgaaagatatcccggtacccaatccctcggagaaggtactggaggtaaccgaatccccaagtgtatcggaagcttccgccatttatgcggctcatggcggtccgcttttggtcgagaagcaaaaagcggatttagggaaaggaaatgaatatacctttgccgtagcgttagatcggacggcctgccgcaagggacatatcgagatcgtaggagccggtcccggcgatccggacttgatctctatccgcggacggcaaatgttggagaaagcggatttgatcctgtatgcaggaagcctcgtcccgaaagaacttaccttatgcgcgaaggcaggcgctacggtgcgaagctcggcggatatgaatctggaagaacagtttgcgttgatgaaagagttttatgataaaggattgtttgtcgttcgtttgcacacgggcgatccttgcatctatggagctattcaagagcaaatgaattactttgatcaatacgggatggattatcatatcactccgggtatttcctctttccaagccgccgccgccgctctttattcccagttcacgattccggagaaagtacaaacgatcatcctcactcgtggcgaaggacgtacgcccatgcctgagaaagagcaactgcacaaactggctcaaagccaaagtacgatgtgtatcttcttaagcgccggtgtcgtagagaaggtccaagaggaattatcgcgacattacgctccaaccactccggtagccgcttgctataaattgacatggaaagacgagcggatctaccgtgggcaactgaaagatctcgcgaaaatcgtaaaagagaatcatcttacactgacaacattacttgtcgtcggggatgccatcgataatcgcaagggtctatcccgcttatatgcggatgaattcaaacatcttttccgtaagtaatgatactgatccttggaggaacgacagaaggccgtgtggctgtgcgggtagcggacgaggcagccgctacctattactattctacgaaaggaactttgcaatccattgaatgcgcgcatggaatccgtttgaccggagccatgaatgcggaggaaatggagtgtttttgtcgtgaccacgcgattaagctattgattgatgcggcacaccctttcgctcaagtgttacaccaaacgatcgaaaaagtatcgaaatgtttacagattccggtgatccgttacgaacgtcggtatccacctcgtgatgaggacttgatttggtgcgatagttatgcagacgcaattcaccaaatggaaaacaaaggtatccaacggctacttgccctcagtggcgtgaacacccttgccccgctccgcccttattggcgatcgcataccacttggttccgtatattggagcgggaggaatctttgtcgttggccgagaagcagggcttcccccaagaacgtctggttttctatcgagaaggtgaggatgagttaaagttgttggagcaactccatccggatgcgatcttgacaaaggaaagtggtttctccggctattttacggataaagtgaacgctgcccgccaattcggaataccagtatttgtcgtgaagcgtcccgcattaccggaaactttctaccgagtgtatggtgaagacggattgcgcaaacaaatcgaacgcctattacccgaattctttcccttgaaaagcggatatacgaccggagcttgtgctaccgccgccgcaaaagccgctttattggccttattatcaaggaaggaacaaacagaaagccagataacattaccctcgggagaacagataacgttgccggtagcctataccgaatgggccgggtgttccgccacctgtaccgtgatcaaggagtctggggatgatccggacgtgacgaatcatagccggatccgggttactgttcaattatctctcgatgcatccggttgtgccatcgccgtggcacgactctgccacggtgatggcacagctgtgccaagccgatggcacaagcgtgccacggtaatggcacaagaagaatattgtcaagaaacagaaagcgacgatacgggaagagtcatcttccaagcaggtgaaggagtcggaaccgtgacccttccgggactcggcttgaaagtcggcggcccggctataaacgccacgccccgtaagatgatccggcaagagctgattccactcctgccctcacccgattccgtcgctattgtcacggtctcggttcccggtggcgaggagttggcgaaacgtaccttcaatccgaaacttggaattatcgggggaatctccattatcgggacatccggaatcgtgcgtcctttctcatcggacgcttttatcgcctcgatacggaaagaagccagtgtcgccaaagcgataggttgcgagacgttggttattaattccggggcgaagagtgaacgctaccttcggagcttatacgcttctttgcctccacaatcattcgtccattacgggaactttatcggagagacgctaaagatcgctgccgatttaggtttcaagcaggttatcttaggtatcatgatcggcaaggcggtgaaacttgcggaaggtttcctggatacacacagcaaaaaagtcgtcatgaacaaaggcttccttcaagatgtagcgaaagaagcgaaatgcgaggaggcgaccgtagatgcaatcaatcggattacgttggcccgtgaattatgggagcttcttgcggaaaaagaacaaaatcgtttcttcccattacttttacaaaaatgtaaatcgtattgcgctcctatccttcccgacggcgaactaaccttgctgttaatatccgaagagggcaaggtcttgtaccaatcttagctgtagagacgcagcgcgcacgctacgtctctacaccccccagactgtaatagcatttctttttagctgtttattcttttttattagggattctttaagaatacatattaggaggatttcgtacttttgccctctaaatattgattaaaataatgtttagatatcttttaatttatatggcctgccttctattcgccttttccgtaaaggcgcaaggcatttccaatgacacgattccgaaagaagtgctgatgctggatggtaagcctatgaccgaaaagcaaatacaacgttatcataaacaattacataaagactccatacgggccaacaaaaggatctggtggtctatccttggcggaccgtcttacacgccggaagcctcctttggcgtaggtggcgcggttttggctagctttcgcttaaacaagaatgatacgatatcccaacgatcgtttatccctgcgggatttaacattaccttaaacgggacgttcgtttttgccggtgccggtaccttattcttcaacgagaatcgcttccgtatttatatcagttacggttatcggaacgaaccttcgcattatttcgggaaaggctatgagacgatcgagcaaatcgagaagagcgactcgacaacgaaattccataagagttctttccaactatatccccgtttcgtatgggaagttaggcctcatttatatacgggtcctctttttgatattaatttcagcaaatcagatgatatcaacccggtgatggccgaagatccttatttcaataagttcaaacgagattatgtcaatatcggtgtcggcggcttgattcaatacgatacacgaaatgacgtggcgaccccaagttccggtatgttactaagcgcgatcgctaaagtgtatggaaagtatttaggcggtgcatataattatgagatgttcgagttagaataccgccaattccagcaagtatttcgtcctcgtagcaccttggcatggatcgccaagacacaaatcggtgtgggaaacgttccttttacggagcttccttcgtttggctctcctttcgatcttcgcggatactattggggcaagtaccgtgacaagaccatggcgtatgggattctggagtatcgtcatatgttcggcagcgtggagaaatataagagcggtaatttctgggcgaagtgtggttttgttggctgggtcggcacgggtacgatcggaaacgctcctatcgtagactggaataaatggaagttcaactacggcgtaggcttacgtatccaaatgcaacccggcaagaacttccgcctagacgtaggcaaagacccgaaccaaaaagggatggcggtttatatgaatatgacggaagccttctaaaaccagaaggctcccgtctacgatttatggaagtataaccttgcgttaaaattatcgtttaaaagccggaaatatcttaatatcgatttttttcactaagtttgcgtcgtcgaaggggtgccatactatatgggctgagatcatacccttactacttgatgcgggtaatgccgccgtaagaaaaacgaatgttagatggataaaaatgaaacgtaccgttatccggtagctttaacgatcgcgggctctgatagtggcggtggtgccggaatacaagcggatattaagactttttcctcgctgggggtttttggagcctcggcgataacggctataaccgctcaaaacacacagggagtgcgagggatccaagcgatctctcccgagattttgagaggacaaatcgaagctattcttgaggatttcatcgtagatgccgtaaaaatagggatgctacataacaaggatgccgtaaaggtcgtatctgaaactttatcttccttccaacagacttctatcattttagatccagtgatgatatccacgagcggaagtaaattattggaggatgacgccatccgaaccatcatggatgagttgttccctaaagcgacactgcttactccgaatattcccgagacggaatatctttccggtataaaaatcaataacgaggcggatatcttacttgccgcccggaaattgcaggaaaaaggatgtaaggctatattgatcaaaggggggcatattcccggagtagaaacggtggatcggttatttatcaatgagaataatccgatttgtctggcctcgccaacagtggagactttcaatacccatggaacgggctgtacgctatcgtccgccatcgccgcttatatggcactcggccattcattggtggaagccgtacgattagccaaggaatatatgaataacgcgctcgttcacggggcaaatgtatgcatgggaaaagggcacggacctgtaaaccacttcttctcaccctctgcccttcataaaatccgatggaatcatgaataagctggtcgtaattactacaccttattttttcgcggatgaagcttctttgatcgaacttctatttgcggaaggaatgtctcgtttacatctacgtaaaccggattgtaaacgtgatgaattggagggcttattggataacatctctccggcctattacgacaggatcgttcttcatgattggtttaccttggcagaagaaagggctttaggaggagtccatttgaacaagaggaacccggaagctccacctttatataaaggcagtataagtcgttcttgccatagtctggaagagattatcgagtataaaccggtatgcgactatgtattccttagcccgatctttcagagtatatccaaagaaggatatggtagcggattccccttagatggattgcgaaacgcaaagggcatcatcgatgataaggtgatcgccttgggaggaatctgcttacaaacaataacgaaattaagagatatccccttcggcggtgtcgccgttctcggggccctttggggaaacgatccctcccttcttgttgcggatcaactcataaaacaattcaaacgattacaagtatggccttaaattattatttcggatatgatgagaatggaagagtcggtcggagaacaaccggattacgccctccttttggtgggagtaaccgcttgatgtttataacgcatcgtacacctaaatatacggaatgcgacgaggtacgcatggcaatccaaggaggatgttcgtggatacaattgcgtatgaaagacgggatctatgaggataccgtacgtaaatgtgccactatctgcgcggaagaatgtgagcgaatcgtggatttctgcgtaaacgatgatctggaagccgccgtgacatgtggcgctacggcttgtcatctaggtaagaatgacattcccttggatatcgcttgggaagtactgaaagacaagttggactccaatgccatcttctatatcggggctacggctaacacgttcgaggatatccggctggccgtagaacgaggcgcctcgtatatcggactagggccgtatcgctttacaggtaccaagaagaatttgagtcccatcttaggtctggaaggttatcgtaaaattatcgctcaatgcaaggaggctggcattgatattcctatctttgcgataggtggtattacgttggaagacgtaggccctttgatggagacgggtataaccggaatcgctgtttcgggcgcaattatcaatgcccccgatcccgtggaggaaacccgccggtttatagaggaaatcaataagtactaaactaaatacatatggctactaaaaagaatatgcgtatttcctatccgtcctcggaaaagatttatgtcccgggcgagatcaataagatcaaggttggtatgcgtaagattaaattgttggacacggtaaccttggatgagcatggagagcgaatcttcaagaagaacaatccggtaatcgtttacgatacgagcggcccgtattccgaccccaagatatcgattgatatcgctaaaggacttcctcgtatacgtgaggagtggtacggtaagcgtaaagatgtggttcaattgccggaattgacttccgcttatggccgtgagcgattggcggacgcgactctggattccctgcgtttccccaagcgatacttgcctttccgggctaaagagggtaagaatatcacccagatgtattacgcgaagaagcgtattatcactccggaaatggagtacgtggcgattcgtgagaaccagcaaatcgaggctttgggactgaagtcttatatcacgccggagttcgtccgcaaggaaatcgccgccggtcgcgcgatcatcccggcgaatatcaatcacccggaagccgagccgatgattatcggtaagaagttcttggtaaagatcaataccaatatcggtaactccgctctttcctccggtatcgacgaggagatcgagaaggcgatatggagttgtaaatggggcggagacacgttgatggatctctctaccggcgataatatccatgagacgcgcgagtggattatccgtaactgcccggttccgatgggtacggttcctatttatcaagccttggagaaggtgaatggtaaggtagaggacctttcttgggagatctatcgggatacgttgatcgagcaggcggaacagggcgtggattatttcacgatccatgcgggtttgttgcgtaaacatgtggagctgacggcgactcgcctgacggggattgtctccagaggcggatcgatcatggctaaatggatgcagcttcatgacgaggaaaacttcctgtacacacatttcgccgaaatctgcgagatactaaaggcatatgacgtggcggtctctatcggagacgggcttcgccccggttctatctatgacgcgaacgacgcggcacaattcgccgagcttcacacgatgggagaactgacgaaaatagcttgggagcagttcgtacaagtgattatcgaaggcccgggccatgttcccatgaataagattcatgagaatatgaaggaacaacagtatgcctgccatggagcgccgttctatacgctgggcccgttgacgaccgatatcgctcctggatacgatcatatcacatcggctattggtggcgcgcaaatcgcttggcatgggacggctatgatctgctatgttacgccgaaggagcatttgggattaccgaataaggaagacgtgcgtaatggggtggtcgcttataagatagcggcgcatgccgctgacttggcgaaagggcatcccggcgctcaagtacgtgataacgcgttgagcaaggcccgttttgatttccgctggaaagaccagttcaatttgtccttggacccggaaagggctttacagtattataaggagagtgctgttacggatggagagtactgtacgatgtgcggtcctaatttctgcgctatgcggttaagtaaggatttgcaaggttgtaaataaaatactgttttgaggggatgagacggggcatgccccgtctctacaattgagtgatttgttttccgcattcgtagccttcctcatatagttcttccagtttctttgtgtcgcttccggtacgaccgactttaatcgggctttgcggacggatgacgaaggcttttccttcggcctccagttggtctatgtaatccaagacctcgttgtaccgccggtatcgtagtcgcaactgttcccggatcgccgggtatttgttataaataaagccgggaaggtaaaaatctttctcttctttccgatagcctttgttacgggtaaggatgatgacgttcttggagaagccgtcggcgatagcccgtcggatagggatggcatcgcatacgcctccgtcgaccatcggtatcccgtctacatacgtaattggacagaggatcggtaatgtgcaagatgctttacagatatccaccaaacgtttcttatctttcttctcctcgaaatattccgctttacccgtcaagcaattgctcgtgaccataacgaaccgatccttggacttgaaataggtatcgtaatccaacggataatacaaatccggatagacataaaacaagaaattcagatcgatatatcccctcccccgtaagaaatgacgaagacctatgtaattatatttcttcaataggtcgatattgctaaaacgagagcgtccccgctggcgggaagcatacgagattccgttactcgcgcccgccgatactccgatcgtataaggaaaccaaatatcatgatccataaaataatccaatactcccaccgtaaatatggcacgcattccgccaccttccaacaccaaacctgtctgactatctatttccatatatatacctctgaattaaaaaagccattgctgggttcccaccaagcaatggccacaaaaatataataaatcagcgataaataatagttcctttttagaatttacttggtcacttcgttcactaagggacggccttcctcgaaatccttgatgttccgcaaggtagtctcggcgatattatgcagagcctctttcgtgaaaaacgcctgatgggaagtaacgatcacattgttgaacgagagcagacgggccaagacatcatcatcgataatcttatccgatttatcctcgtagaaatagtctccctcctcctcgtagacatccaatccagcggcagatactttcttggtcttcaatccctcgatcaaggcgttggtatggatcagtaacccgcgtcccgtattgataatcattacgccgtctttcatcttggcgatcgaatcgtcgttgatcagataacgggtctggtcggtcaacgggcaatgcaaggaaatgatatcggactctttgtataactcgtctaaagagacataggtgatcccttcctccttggcgaatttctcatccggatacaggtcgtttgccaatacacgcatccccaatccttttaagatatgaatcaatatcttggcgatctttccggtaccgataataccggcggtcttgccatgcatatcaaatcccatcaagccattcaaggagaagttgccatctctcgtacgccagtatgcccggtgtatcttacggtttaacgataacatcaaggccaacgtatattcagcgaccgcatagggtgagtaggccggtacgcgtacgaccggtaatttccccctggcggcattcaaatccacattattaaaaccggcgcaacgaagcgccaacagtttcacaccattggcaaccaaagcgtctattacggcggcatcagccgtgtcgttcacgaaaatacatactgcgtctaccccttgggttaagacgacattattgatattcaaatgtcctttatagtaacgaatatcgaactcataccgctcattgatcttatcgaaagaagcgatgtcgtagggtttagcaccaaaaaacgcaatcttatacgccatataactttagttttttaatataactaaattaagcccttgattgtttatcgaaaaagaaatccattcgtttaattatagtacttttgtccgctgggtaacaatatagatgagcatgaatcaatcccataaaagatcttttatagcagttcttatttttattggctttctcttgtttatggcattttggggcatcgacttgatcttaggggcgtatgcgggacataaattgagtaaacttgccgaaaggcatcatcttgacatacgctatgataagatctggttgatggggctgagtaccgtacgtatggagggattgaccgttatcccggttgacgctgatacgttgatacatgcggacaggcttcaagcgaaactggagcttggcagattattgctacttaccccttccatagagagtgtacaagcggataatttgcatattcattttattaagaagggagagagagctaattttgatttcctttataaaccatcgaatcacccaggtgagccagtggaaacagctgtagatgataaggaacgggattacgcacgcaaggctgaacgctcccttagtctacttttcaatttattgcccggaaatgccttggtacatgatttatgtgtttcttatagtaataaaggagatgaactaatactagagatacccgaactcaatcttgctaacaatcaattctctacgcatataaacagcacggagaacggagttcgtagcgaatggatttgcgaaggctctctctctgataaggagcgactcgtgaaagcccgtctctacgccgacgagcatacgaagattcctcttccttttctggaatatcgttggggggcatcggtacgtttcgacaccttggccttcgagcttaagggacctaaaatagaagaagacatacaatccttactcggaagcgcctatgtgagcgggcttaccatccaccaagagcgtatatctccggacacggtcttactggataaaggctctatacacttccggacaaacatcggtaagaactatatcgaattagatagcgtcagtgatatccggtttaatcatctggatttccatccttatctgaagatcgttaaagattccagttggcaaatcatggcctctgtgaataaaagggatttccctgcggatcaactgttctcctccctgcctaaaggcttattctacaatctggaaggcctgagaacaaaaggtaccctctcctatcattttcgattggatctggatttcggacaggtagacagcttgatcttggaatctactttgaaagcgaaggacttccagatccttgcctatgggaatacggatttgcggaagatgaatgagccatttgaatatactgtctatgagcaaggcgagccggtacgctctttcgagatcggtccggcgaatccctctttccgcccgttcaacgccgtatcccgttatcttcctttagcgatcatgcagagtgaggatgccggcttcttttatcacaacggttttattccaagcgctatccgggaatcgttgatacaggatatcaaggaacgacgtttcgcccgtggcggcagtacgctcagcatgcaattggtgaagaatgtattcttgagccgtaataagacgatcgcccgcaaactggaggaaatgttaatcgtatggctgatcgagagcaatcatctgacctcaaaagagcggatgtttgaggtttatctgaacatcgccgaatggggtcccatgatttatggagccgccgaggcctcacgttattatttcgcgaaggaaccttcccaattaaaccttgccgagtgcatttttatggccagtattatccccaagcccaaacaggtccgctattgcttcgacgggttgcggttgaagccgtattatgaggatttttacaggataatactggatcgcttggtagatcgcggacttatatcttcggaagaggcggtaggggtaacgccggagtctgtcgaaataacaggtccggctaaagaatatctgacggctacccaaagtcgatctccacgctcgtcccaacccctagatcagaaataatattcaccttcgccccataggtgctcaatatgcgtagcgagaggcttagcccgacaccatgcccggcgtattcccgggtattgctcgccctgtaaaagggttggaagattcgtttcaattcctcgggaggaatgccgatacctcggtcggatatggtcaagatactgcctcgaagccgcatctctaccggtttatcgttcgaatacttacaggcgttgctcaagatattcttgatcgctatcttcaataaatagggattggcacggatcatataagagaaattatccggggagaacgagatccgggccgaggagaactgcatcaagaagtccgctaggaagatcgtctccatcgcgcttttctggatctccttatccccgtgcgacaggaacagcaggtgtttgatcaattgtatgatacggctcgtctccgtggcgatacgtcttaatgccgcttggtattcctccggggagcgctctttcagcaggctgatctcgcattcgccttgaatggctgtcagtggattgttcaactcatgcgaggcgttgctgataaacgctttctcactttggtaagcagcgtcgatccggtctaccatccgggtcgcgtatagtctgccgacaaaatagatcaataccgagctaaccaatatcaatcccagcaacagccagccgatccgatgctggatatccatcccatactgattcccggaaaggacaatcacgatgaaattcccctcgttgtcgggataatacaaagccgctcccatttgcgtatcgtgcttgaagtgaacgatatcctcttggtatagagatctcacctgcgtggcgtccagataacgggacagcacttgccgggtctccaagctatcggcgttcagcaatatctcggtagcgacgggaagggtttcctcgtaacgctgttggatacgggcatagctctcgtcgtcggtctcgtccttctcccaatgcttctgtgccgtggcataggctttttccgtcaggtaagaatagtacaggcgagagatatagctcgtggaaacccaatagaagacaagcgtcacgacggctatcacgcctatggtaatggccgagtaaaagagagcgatcttgtttcctgtcttcatgcttccatcatatagcccacgcccaccacggtatggattagcttaggttcgaagtccttgtctatcttcgtgcgcaaataattcacgtagacatcaaccacgttcgtattggtatcgaaatccttgtcccagacattctttagcaagttcatccggctcaaggccgttccttggttctgtatgaaatattccaagagcctatattcctttacggtcaaatcgatgacctgcccattccgtatagcccgatggcttggaggatctaagaccagatccccgcaccggagagccatatggacggattcgtttcccgatcgacgtaataacgcctttatgcgggcctcgagctcttggaagctgaaaggttttaccagataatcatccgccccggcatccagcccgctaacgatatcctcggtggttcccaaggcggtcagcatgatcacgggggcatggtaaccgaaccgttgccggtactgtttgcaaagttgcaggccattcatcttcggcattataatatccagaatcagcaattggaaatcgttcttctgtgtcagttcccaaccggcggcaccgtcgtaagcgacatatacctcatgcccgaactcccgcaagcctctttctataaaagaggcgatgtttatctcgtcttctactaataatatcttcgccattgtatcgtatgtattaataagaatgtccatcattagtaatgcgtacttagggtgatgctaatcgtatcacagaggtgaatcgttcttttcacggttgtgatacgatcgtttcacctctgtgatatgatcttttcacagccgtgaaaagatcagtaagtataatcctttcgcataataactccagtcgccctccctgatagttccggactttcttgctacaaatatagcaattacaacctacgttgcactaatttaccgttcttatcgtaaagcattcgtcgataaaaagcctccaccatcaacggaaagacaaagagggtgaagaacgtggctcctattaatccgccaatgatcacgatcgccaaaggacgctgactttccgatccgataccgtggctcaaggcggccggaagcaggccgatagcggccatggaggcggtcattaatacggaacgtacccttgatttcacgctcatcttgatcgaatcttccagaggatgcctctcccgcaggttattcttgatgtccgatatcatgatcacgccattctgtatacagataccgaagagggcgataaagccgatacccgctgagatcgagaagttgaaattcgtgattaatagggccaagatacctccgacggcggcgtaaggcacgttcaataagaccagtccggcatcccgggcgttgccgaaaaggacgaataggatcacgaagatgatcgctatacttacggggacgacttgggccaagcgtttggtagcccgttgttggttctcgaaatctccggtccatttcaaggtatagccttcggggagctttacctgcctctccactttccgctgggcttcagccacggcgctacccatgtcgcggccccggaccgagaatttcacggcgcagaaacgagcgtggttatcccggtagataatcaacgggccggtaatcgtatggatatccgccagctcgcggataggaatcatggaaccatccttcgccggaaccagtatcttgcctatctcattctcgctacggcggaaagcggattcgtagcggaccatgatattgaacttacgctcgtcctcataaagcagagaggcactcttacctcctatcgccatctcgataatggattgcacgtcctccttggccacgccgtagcgggctaaacgagactcgttcaactcgatccgtagctccggctggccgatattccggataacgcccagatcttcgataccgtctacggtctccaagaccttgaaaacttctaccgcctttttctccgactcgtatagatccttaccgaagactttcacggcgatggaacccttcacgccgctggccgcttcctctacattgtccgagataggctgcgaaaagttaaaatccacgcccggatagatcgccagatcctcttgcatcttctcgatcagacccgctttcgagcgttcgctttcccactctttctcgggatatatatccacatggaactcgatgttgtagaaacctgtcgcgtccgtgccatcgttcggccggccggtttgcgacaagacctgacgaacctccggataagccgccagcttccggcgcatctggttggccaatgtaacggattcatccaaagatatactttgcggtaaggtcgcacggatataaatagagccctcgttcagttgcgggagaaactcgctgcccaacaaggtgaagcaccagatacctacggcggctaccagcgtggcgaacgtgatcgtccgcttcttacgggcgtggcaccagtcgaaaataccgatcgacttccgattgatccacgcaaggaacggattatgtttctcacgcacctctttccttaatagcatggaagatagaacgggtaccaatgtcaacgtaaagatcaacgctcccaacaaggcgaaccccaaggtataagcgagcgggctgaacatctttccttccaccttctggaaagagaagatcgggaccaaggctgtgatgataatcagcttagagaagaaaaccgctttcgcacggtccttcgccgtatgacggataatacccatcttactcatcaaattgaaagcgggcatgcctacttcacgggctttccggtccaatgccacgaaaagcccctccaccatcacgacggcgccatcgataataataccgaagtcgatcgctcccatagataagaggttggcgctcatccccatcgcccggagacaaataaaggcgaagaggagtgccaacgggataatgatcgacacgatcaccgtcgtacgccaatccgccatgaagattaatacgatgaaagttaccagcagaataccttccgccagattatgtgttacggtcttgaccgccagatctaccagattctcacgatcgtagaacgatacgattcgcacgtcttccggcaaggcgttttgttggatatccttgatcttatccttcaaggcggcgattacctcgccggggttctccccttttcgcatgacaacgatgccttgtacgacatcatcttcctccatgcggcccacttgccctaggcggggaagactggattcgtgcacggtagccaagtgcttgacaaggattggcgtgccattgatattctttacgacgatattctcgatctcttttacatcgttaatcaagccgataccccgcacgacataggcttgcgagcttttcgtgatcacgtcgccgcctacgttgatattacttttcgcgatagcgtcataaagttccaaggtcgttaccccgtaactgatcagttgattcgggttgacgctaacctcgaatgtctttacctctcctccgaagctgacgatatccgctacaccgggtacggcccgcaacttccgctcgatcacccaatcctgcaaggtcttcaattcccggacggaacgcttatcgctacgtaatgtatagcggaagatctcgccggtcgggccgtataagggctgcacttccggcgtgaccccttccggcaggtcggcgtcgttcaagagattataaacttgctggcgggcgaagaaatcatccaccttatcttcgaacatcacgttgatgacggaaagaccgaaaagggtcgtgctccggatatccgtctttttctgtaccgggttcatggcgatctcgatcgggattgtgataaacttctcgatctcctcggcgctcctgcccggccattgggtgataatcgtcaccttcgtattcgtcacatccggaaacgcgtcgatcggcgtatggataaagctggtgataccggcgattacggtgatcgtggtacagaagaagataaagaatttgttccggagggagaacgttatgatattatctatgaatgtgtgcatatcgtctggttactttaattcgttatacaccaagagagcgttccgatctacgatccgatccccatccttcaagccggatcgcaggtaacagaacttctcggtttgcttatacaccgagatctcacgcatttgcaaatatccctccttcgagacatagacaacgtattctttaccatcctcgaaaatcacggcatgggcgtttacgcaaggcatactttctccttttaccgcgctctgtacatatacgttcgtaaacattccgggtttaagcatatacttctcgttccttaatttgactcttacgctcatggtcttactttctcggtctagcatatgatagaccttatcaatcgttcccgtaaactccatatccttataggccaaagtggtgatacgaacggtagccccctcttttaccttgctgatatctccctcatagacatcggccatcacccagacatcgtcgagaccggaaatggtaaacatctcctccccttgatcagaacggatctgcatatcccggtttatattcttatcgatgataaagccggagaccggcgctttcaccacataggtagatgggtctgttatgttataaatggaatacatttcttggatacgtttggtctcggcctcggcatcggcttgctcttgctgggcttgcaggaagtcccggtcggaagccataccgctccgggccatatcttgggtagcctccaagttacggttagcgatagccagttgatgctcggcctcctttcgctgcttgtcgatatcagcgatctcgccgctccggatcaccgctaggacatctcctttccctacgtaatcgccaacttccgcatgaatggaggtgacatttccaccaaatatcggatacacatgggccactcgctctggattgaaactgacacggccattgagcaataactcgttggttaatggtgtgtcacgaaccgtatccagtgttataatctcctgtaaactgtcatttaatagtaaaggttcccgggtatcgaccgaggtggtcgcctgtttcccgcaggaacataccaagggtactaaaaggatgcatgtgattagatgcttattcatatcgtttgatttgcttttaatagttgaatacatggctacccgttacggtatttacctcctccaaggccagtaacacttctttttgagtttggtaaagttgcaagcaggttgttttgtaggtctcataataatcgataaactcaaggagactgatattccgtttttggaaattcaagttcacgccttcgataatcaaggcgaaatccttctccaatccatagttcgaggaacgataaagctgaatcgccttttccaatcgggcatagctggtgaataattcattctcggcctggcggcgtgcgtattcttccttatgggccttttgagcgacagatattttcgccgcccggatattcccttgattccggttaaatataggaagggagacgctcaatccgatcgcccaataatcattgataaagttaccggccttatcatacgtaccctttacgctcacttccgggaaagcgagggaacgttgtaatctcacgtccgcctccgaagccttgatgcttacttgcgccaacttaagatccggacgttcgtataataaagaggtcaattctgagaaagggacggagtccatatcgatctggttcaacacagactcatcgaatatcggctcgaaggtatcattgccggatattcctagtaaaagccgcatgtctccttgaagggagattgcttgattggcgatatcattccgctcttgccgcaaggaaagcaatagggcctcgatacgggacttctctaataaagaaacattccctttctcattctgctccttgagaaccaccaacagatgagccaatgaatcaatctcacgatcgtaaatagattgggatttctgggtgaaataaagcgttacgaatttctccttcaactcgctccggagggttcttaatacttcctcgaattggtaaagggccatttccttatggatcttctccaaacggacacgtttgtttcgctgtccggcgatatagatcaactgttccacctctacgatcgtttccccttgtttcccgaaatcaaagtaatgcccgttcaaccggttataaacattttgctccaaagagaccacgggattctcgaaaagtttggcctgtactacttgggcctcggctatatcgatattataccgttcggctatcacttccagattgtgttcagagaaacgttgctcggactctttcaaggagagggagacaacagaggctttcgccccagagaaaagaagagataaaaaaagtaaaagagtgacttgtctgtccatttgcgttaaattttacgcaaaggtagaagtcactcttttatcgcttatgaatatttagttagaatactcttaggccaaattagaaatttattagagagatttaaagtataatattgttttctttaatccttcctccaaacaaaccgtaggttcccacccatctaatttctctttggccaacgtaatatcgggcttacgttgcttgggatcgtctcccggcaacgggcggtatacgatcttagaggaggagtttgtcaaacggatcacgatcttggccaactcgttcatcgagaactctcccgggtttccgatatttaccgggccgataaaatcatccgaggtattcatcatacgaatcatcccctcgatcaaatcgtctacatattggaaactacgagtttggtttccatccccataaatcgtaatgtccttattttgtaatgcctgtataatgaaattagagacgacacggccatcgttcgtactcatattagacccatacgtattaaagatgcggatgattttaatgcgaaccttgttttggcgatggtaatccataaataaggtctcggcgcaacgcttgccctcgtcataacaagagcgaggccctatcgggttgacatttccccaatagttttccggctgcgggtgtatcatgggatctccatacacctcactggtagatgcttgtaatatcttagcgttcacccgttttgccagacctaacatattgaccgctcctaatacggatgtcttgatcgtctgtatcggatctatttgataataaactggagatgcgggacatgccaaattataaatctcatcgacctcggcttggaacggtatagaaacatcatgcctgatcaactcgaaatgtggatttttcagcagaggaatcacattctccttacttcccgtaaaatagttatccagacaaattacttcatttccttcttctaaaagacgggcacataaatgagaaccgataaagccggcgcccccggtgataagtatttgcttcattatattaaatttatttcgtgaatttcaccctataaggtggatccggacgtaaataatctatatccagataaggaatcttaggatagatcaagtccagatagcggaggtctaaggggccgggaacgacttctatccgtaccttagcgacacctttatcgataaaatccaatatctcggcggcgctcgctgatacatcaatgattcgttttctataacgaggtccacgatccgttacgcatacaatggtacttttcatattctccaagttcgtgactcttaaaaaagtaccaaaaggatacgtacgatgcgcggcgactaattcttctttatcatgaacccttccactggatgatttcctgccgtggaaacgatgatggtaatacgaagcaagtccttcctcctgtgcccatattccttctccacacttaactgcggcaaatataagtaatatgtagaacaagcggaaggacatgtaccttttttaatcaattattgaagcatttttccattatattctccgttcaaagttcctagaaaaacaacgattttttcaacttctacatcattgatctcctttccgatctggaactcatgcatgatacggatcgcatcctccacggaggctacggttccgtcgtgcatgtacggataagtcagcatcacgttacgaagtgtcggggttttgaacttatgacgatcggattctttcttagtcacggcatagcgtccgttatcaccgtccgtcaaccctgtattccggtaatcgaaatagctgttcttgatacccatgaactcgtaagattgaccaccgacatttacaccaacgtggcaagtagcgcatttattgtccttgaatagttgatagccctctaattcttccgctgtaagcgcgtttttatctcccatcaagtatttgtcgaaacgactcggcgtaagcaaggtcttctcaaactcagcgatagcgtccgtgatcgtagattgagaataaccttccggatacacttccgtgaatttcttcgtgaaatccttatcttgcgctaaagcctcgcaaatctggtcgaatgaggtacaacccatttccactgggttcaatggaggaccagccgcttgctcttttaggtctgccgcacgtccgtcccaaaattgaacgaaattaagcgccgcattatatacggtcggagcgttaacaccaccgaactgtccattaataccttccgaatattgcttacggtctacaccacctgtgttcaatccgtggcaagtagcgcaagagatcgtattgtccgcagacaaacgagtatcatgatacagggcaaaacccaactctaccttcgccggatctgtaggcaagctcttcattagaggctgaagaggctcattcttaaattcttccgctacggtttcggtcgtgaaacgatctttacggacattcttcgcccatgaaatgatcaccgctttctcattgtcgtcaaggctagttccccagtgcatcggcatatgggaatacttagccgggggcatagagccgcttagggccgtattctccaccttcgccaaatcaacctctgaaacgggctgcccgttctccaaggcttccaccatagcagtcaagtccacatagtgaacggcctccttcatgtctgcctgtactacgggaccgatcaacggtaaattaccgtaaaatggcagaggcgcattttcagagtggcaggccaaacagtcgttttcccgcaggatagaggccacttgcttaccttcattgtcggcaaatttcttgtattcggaagaaccgcacgaggtaaccgcaaaggctaaagcgcagagtcctaccggtaatgccgtcattttagcataaattgttttacgcataactatatttatttagatttattaagtgcaaatatagaacaattcacttacatgtaccctaaaagccttggatttcattgatcagttttatctatgggaagataaatagaatctatgcggtgggcttccatccgcagcatcgcggcaagctccttcctataatgcccagtatgaggttctaacaatgggcaatataaggatgttacaatgcccattataagcagctaacaatcgcagttataagcagccgccaatcgctatgtggataatccgatttttttatatagctttgcctcattatgtataatcaataaattataaggcaaagatgtttaagaacaaagttgtatggattatcatcgctatcgtagcgatattattcttttgggtgaaaggtgtgtataataatatggtaactcaagacgaaggcgtgaaaaccgcatggagtcaagttgagaaccaatatcaacgccgtatggatttgatcccgaatctggtaaatacggtaaaaggatacgccgcacatgagaaagagactttagaaggtgtggtcaacgctcgtgccgaggcgacgaagactacgattgatccttctaaccttactgaggaatccttgaagaaattccagtccgcacagggtgagttaggaaatgccctctcccgtttgatgcttgttttagagcgttatccagacttaaaagcgaatcaaaactttatggagcttcaagcgcaattggaagggaccgaaaatcgtatctcagtagagcgtaaacgttttaatgaggtagctcagtcttataatacctatattcgccaattcccgaacaatattttgtccggaatgttcggcttccaatcgaaagcttatttcgccgctgaatccggtgcggaaaaggctcctaaggtagaattctaatagccattcgctgaatgagtgagataaagaatataagatctaggcgcaagtgtccggtaagccttttatggatcagtttattgctggttggttttgcctcctctattttcgcggcaaaggattattcgatcgagaccattccgaacgtacgtctttccaaccggttgaaccatgtcagtaatccggatggtatcattaccccggatgacgcggcacgtatcaatcaattattaaatgtagtggaagatagtctcggtatcgaggtagctgtcgttgccgtgaatagcatcggggatcaggatgcccggatgttcgccacagatctatttaagcattggggcttggggcagaagagcaaggataatggtttattgatccagttggtgacggaaccttcccaacgttcggtcgttttcgagacgggatatggcatcgagggtgtcttacccgatgcgatttgctaccggctccagcagcggtatatgatgcccgatctaaaggccggggattatagcgccggcatgttgaaaggagtcatggcggttaccaagtatttaatgtccagcgactatgaacgggcaggcatgactggcaaccgttcttcttcctcgtccgatgatgattttatgtggatattcgtggtggggattatcgggatgatcggtttctcggcgtttatcgcatacttaaagtatcgtccgaaggcatgcccccgttgtggaaagaaaacctttgtgtatatggggcagcaggtgatccgggaagcgactcgtttttcggaaggtctggccgaagatgtatatcgctgtaagagttgcgggtatacagagaaaaaaaatcgtaccatcgaccgcatacaccgaggaggaggtggccctattattatgggtggcggtggtggtttcggaggttttagcggaggcggcggtggcggctcttggggaggtggaagctccgggggtggcggttcgatcagtcgtttctgaaaatacgattattcgcattattttatacaagcggtcacgtaaaaccttatgtgaccgcttgtgtttttatatcctattgttctttcagatagtagtcggaaagtatatcccgtaccttctcgggagtaacccttccatagaccttcccgccgatcatgaccaccggagccaatccgcaagcaccgacacagcgtaagcaatccaaggagaacaaaccgtccggtgtagtctctcctacctttatttccaattgacgttgcatttcttccagaacattttccgcgccacgcacgtaacaggccgttcccagacaaaccgagatggggtatttccccttgggggtcatcgtaaagaatgagtaaaaagtaactacgccatatacccttgagaccgggatattcaattcggcggcgataacctgttggacttccggtggtaaatatccgaacaagccttgggcggcgtgcaagatattgatcaactccccgggatcgttgttgcgttcagcgcatatcgcatgtagctccgctacttttgttttaggcaaatgtatctcattcatggcttatttacttttttcagtttctatatacataccgattacttccttacgatctatgtaatgggtatgcagtaatttgtgggctttcggtccgcaaggctctcccaaatactcgctgtataattgctggatatacggattctcatggctcttgcgaagcggtttgttagcgtcttcccggtaaagagcggcagcacgccggcgaagtacctccatacggcctcggtggaacggttgtccgccaccgccgatacagcctcccggacaagccatcacctcgatcgcatgataaggagaggtaccgttcttcacctcctcgatcaatttgcgggcattccccagaccatgagcgataccgatctttaccggagtcccattaaaatcgatggtagcgctacgaataccttccagtccgcgtaactcctcgaaatccactttatccagatttttcttcgtatataattcataagctgtacggcaagcggcctcgataacaccgccggtagtaccgaagatcacgctcgctccggtagattcacccaacgggcgatcgaactcaccatccggcagttcattgaaatctatattcgcataacggattaaacgggctaactcacgagtatatatcgaataatctacatcgggattaccttccacgctaaactccgggcggctagcctcatacttcttcgccaaacaaggcatgatagatacgactaccaaatccttacggtccactcccaacttctcggcgaaatagctcttggcgatcgctccgaacatttgctgcgggctcttggctgtagataaattatcccgtaactcggggaaatgttgttccacaaagctaacccagcccggacaacaactcgtcattaacggtattttcacctctttgtctccattcaagtaactacctaggcgatgtaataattccgttccctcttccataatggtcaagtcggcggcaaagtccgtatcaaatacataatcaaaacccaattgacgcaaagctgaaaccatcttgcctgtaaccaatgtacccggctcatacccgaaatcacgtcccaacgctgtgcgaaccgccggcgctgtctgggcgataacaattttagtaggatcggccaaagcgtccaagaccggctgttgcgtattacgtccgctaagcgcgtttacaggacagacggatacgcattgtccacaataagaacaggtacttccggccatatcccgttcgaaagctgtcgatacggccgcgttaaatccacggttcacggcagtcaaggcgccaaccgtctgtatcgtattgcacatggtctcacaacggcggcacatgatgcatttgttcatgttccggacaatagaaggggaacgatctatcgtaaatgtagacatttctcccttataccggatctcgcggattcctaggtcgtgcgcgatcttttgtaactcgcaatgtccgttgctactacatgtcaggcattccgccggatgattcgagaggatcagctccatcaccgtcctgcgggcattcattacccgaggggtatgtgtccgtacgaccataccttccgtacattccattttacaggatggggctaaatttctacgtccctcgatctctacgacacaaatacggcaagctcccggattattctcataatgcaaatcctccagtttcatataacagagtgtcgggatatggatacctacactttttgccgcatctaaaatggtggttcctctcggcacttccacctctttattatctatgattaatttaattgtttccatgattgtaaatgaatttagtggacataaatcgctccgaacttacacttctccatacaggtgccgcaacggatacaagcttgcggatcgataatatgaggaattttccgtccacctgtaatcgcatgcaccggacaaacacgggcacagagcgtacatcctttacatttctccggattgatgaaatattgagtaagttcccggcattgatgagacggacaacgatgctcccggacatgcgccagatattcatcgtagaaattatccatcgtagataaaaccggattcggagaagtctgtcccaagccgcataaagcggtatccttaatcaccatcgccagattccttagacgggtcaaatcctcttcggttccgtttccactcgtaattttctgcaatatctcatgtaagcgtttattaccgatacggcacggtgcgcatttaccgcaagattcctcgaccgtaaagtccagatagaacttagccatggctaccatacaatcatcctcgtccatgacgatcatacctccggaacccatcatggaaccagcggcaagcaaattatcataatcgataggaagatctagatgcttttctgtcaagcaacctcctgacgggccaccggtttgcacagccttaaacttctttccatccttgatacctcccccaattccaaagataacctcacgcaaagtcgtacccataggaacctcgatcagccccacattgtttacctttccagccaaggcgaacacctttgttcctttgcttttctccgttccgatactactgaaccatttagcgcctcttaacaagatcaccgggatattcgcataagtctctacgttatttacattggtcggacaacctttatacccgtgttcactagggaacggcggctttacggtagcctcgcctcgcaaaccttccatactgtggatcaaagcggtctcctctccacaaacaaaagctccggcaccgtaccggatctcgatatcgaatgagaaatcagtcccaaatatattctcgcccagcaatccatattctttcgcttgccgtatggctattttcaaacgttccacggctagcggatattcggcacggatatataccaaacctttgctagctcccgtacaatatccattaatcgccatagcctccacaatcgaatgcgggtcgccctccaatatggagcgatccataaaagcgcccgggtcaccctcgtccgcattgcaaaccacgtatttttgaggtgcttgtaccttacgggtaatctgccatttcaaacctgtggggaaaccaccgcccccacgaccccgtaaaccgctatccatgatttccttgattacttcctcgggagtcatttccacaagggcttttcctaacgctacatagccgtcacgagcgatatactcatcgatattctcagggttgataaagccacaatttcgaagggcgattcgtagctgtttcttatagaatctgatatgcttggagtccggaaccagctcacgggtctctggattcatataaagtaaccgttccactttacggccttttaccaaatgctcccgtacgatctcgtccgcatccgatggttgaacttgtacgtaaaaagtgttatcggggatcatcttaaccaccggacccttctcgcagaaaccgaagcatccggtacggatcacttgtgtatcctctaatccgtattgctcgacggcggctctcagattctcgatgatctgctcgctttgtgatgcacggcaacctgtgccaccgcacaccaatatataattcgtgtattgtgccatttatgtaagatattaaatttcttattcgggttttacggtggtgtaagttacaggaatgatgccgtctaccaagatacccttacggatatacttatctatgatctcttctacttttgccttatcgacataaccgaataccaacggctcctgacccggaagcttgatttcgatagtcggttccgcataacaatagcccatgcatccggtttgagttaccaacgcatcgattttctgccggtctaaaacctcgataaaataactcattatctccttggctccggcagctataccgcaagtggccatagaaaccttaatttgtacgagctgatcaggggtattgcttttttcacgcagatccaaagacgcacgaagagattcacgcattttcttgagatcatctaatgtctttactttgttcatggtcatattctattatttaaggaaaacaccgtaatgtcatttgcacaaacatacggaatctctttcaaataatatcatatttccgtgaatttttcttcgacacgtgattgagatatcttggaattgggaggtacactatgggtgagccagatgttacccccgataatagatcctcggccaatagtgatccgtcctaatatggatgcgttggaataaatggtcacataatcctcgatgatcgggtgacggggcaaatctatcggaagtccttcctcgtccagcgtaaaactcttggctcctaacgtcacaccttgataaaggcggacatggtttccgataatggcggtttgtcccacgacaatacccgttccatgatcgatactgaaatattctccgatctgcgccccgggatgaatgtcgatcccggtttgcgagtgtgccatttccgtaatgatacgcgggagtaccggtacgcctagctcgaataattcatgagcgacccgttgatgtaaaagcgcgtagaccgccggataacagaatataatctcactcacgctcttggctgccggatcaccatccaagatggcctttacatcggtggacagtaaatatttgatatgaggaatccggttaataaaagcgatcgagatctcggaagcccggtccttggaatcacaacaacgctctacctcaaaacaaagtccattatatatttgctcttgcaagagatcatagatcttttccaaatagactcccgtataatattggatagagcctaattgagcctcttgttccgtaccaaagaatccggggaagataaccgtacgtaataggcgcatgatctcatgcaacgtagcgactgaaggcgatggcttctgatgcaacgggatatatttgtattccggtagatcaggagccgacagccgttctacgttcttctgtatctgttctaaaatcgctgttctattcatctttaattatcccaagtaggatcgtaactgattaatgagttagaggcattgcccaaacctatatagatataattatccaagacatacatgcaatgtacagacctgttagccgctggtaactgggatttctggctccagttctgagagtccggatcatagcgccaaatataaccgtccccgtctacgccatatacgtaattaccataagcgatagcacataaaagcatccttccggggaacgaagcctccttttcccaagctacagcgttcttgtctgtagaccaaaactgtgtcgtatattccaaagaaggatccgctttattaataatccccagtccggcatatatacggtcaccaattacaacggatattccgccgtattgtttaatcgggaaattagatttcttgctccaaacgaaagcgctcggttcataagtccagacttcatcgattagttcgttacctctacgtccacctatgaggaacgcttgatcttccattctgcaacatgccgcccgatacatacctttaggccgttgctggtctgtttgtacggcgctccaagaattatcggatgtggagtatacatataaactgtcacatatctttcccgtgttatccaaaccaccaaaagtccataggccaaatccgatgctgaaacatgcttggcccgataatttctcaggctgagaccttaagggcaaccattctttcttagaggtcatatatccccaaaactcatcggtgtattccctacccgtgtcaccgcctaacaagaatcccgtgctattagccaaggtacagaaagaggtagatcccggtatccggaaagctccctcaaaccttgcccctgctccaaatatatccggagtttggaagcgaacttcctctccgtaagcgataccattcttatttttagcgtaagcccttaaataatagctcgtgcctcctctcaattcctttatcgtacccgtaaacgcttgtgtaccggaagaaagagctaccgctccttcacaattaccaaaggccggactaggactagttccccaacatacaccggcctctgtaaccggtgaggcaccttcggctaagacctctcctcctacccatgcggtaccgtttttaatagtagacacctccttcgtattgactgtaggcaactcactttccagaatcgtatggataccttcgcctgcgctataggtagtacctaaagcgtttgtcgcataagcacgtacgtaataccctttctgctgttgcatatcatagattttcccggcaaattctccgatacccgctccgcaaataatcgtatccccattttctattgtcggcgatttatcagcactaaagcagaaaccacatgccgtgatcggagaatctccctcgcttattatttccatggagaactccgcataggtaaactctgtcgctattttcttgaatttgttatcatctaatacaggacgaccattcgtggtcttaaaggtctcgactttcgccccgttatactcaccatatttactttttgcgtaagctctaacgtaataggtagtttccggttttaaatcggagatcgtacaatagaacgaatcggcttccatgtctatacgaatcgtggagtcggatgctgaaggctccggattcagcattaagtaaatacccctttcctcgatttcggcttccccttgtttggttatcatacctccacattgaacggaagtagacatcacgttgactggcaataaggtcttaacgcttcctaatccatctttcgtcttaaaaggtaaaatctctccataagcggtatctaccgcattgatcgcataggcccggatatagtaatccagatcattggttaagccctcgatcgtagcctcatattttaccttacgcttggatacggcttttttatttttctctatcacagtaaaggtagattccgtgctccaacaaaaaccggcctctgtcacgggagcgccgttttcttgcaagacctcccccgatactgtcacggaactagccgtggacttcaatatctcgtctgtcttaacagacggttttttagcgtttcgaatgccaccatctatatccggatcattcacgcatccggccattaataaagccgcaaatagaatagagaagagtgagtatatatgtttcataaataatcaatattaaaagaatacacctaagccagcgtttagatccaagtacttaaaattaaccgtattgcatccaacgctaataaatacagagttcgttattttcatcatcaagtcaacctcggcagcgacccctttgtatgaggaatcaatattccggcaccatacctctcgtgtactgtcgtagttttcataggaatgggtcgtgaacgaatgtagtaaagctctttcaccatatcccaaaccaacagaggcatataaccacggaaagcattttacgattaaaccggccgttccggctatactatttgtcttcgaggatttacctgtattaagctcataagattccccttccgaattagagaacttaataatctgcccttggttattacattcgtccgtataattcataaaagacatattcgtcttgaaacggacataccaaccgaagcgttgccccatacctcctaccgtgattccataaggagattcgatcgaatacgagtatcccgcgaaaaactccattcgtttcttaggggataccgctgcggaatctatcggttgggcctcgggttccgccggctttaacaacatctcttggtattctttccaataggttgctagctcctcacttttaggggttccgataccttccgaataataaatgattaatttagagatggcatccggatcatcttccgtagctttgaccgtcaggcagtttaaacatttattcatcaagctacgcatggaaggccgcattcgctcgttggaaagccaaatcgtagtcagctgatcaatactgtatgcgtcgcattgcgatacgccttcctcgtaccacattttagcgtcactataatcaagacgtttcatcgcttcatctcccttacggttgtattccgtacgctgttgcgccagcagtccgaggggaaataccgcacatatcatcaatatccaaagtcttttcatataataggtaaatacatgtttagttgttcataatattacaatcaataataagtaaggccttcgctaatcaatgatccgtcagaattataaatatcaaacaaattgtcttcccgttcgaatgcccggccgttatccgcgataccgacacttaggtatttgcaaggaatacgttcctcggctttcgaatcgatcgccccgtatctgttatttgacttcttacgtacgatcttatatcgtccgaaagccattttctcctcatacagggcctttttgtccgctatacgtttctcctcggttttctcatcacaagcgatgatcaaccggactacctcttccgtaagtttcgtatcctttgcctccgacaaatctttcttagctcccaaataatcagctttggccattttttccttaccggaggcgattaacgagttatatttctcattcatctcattttccgatggctgatccgggagaacattctcttctatcgtatgctctgtttccataggtcgtttctcttccactttaggctcttgtttctccgcttcctttatctcagagataggaggttccgtatgtaaaactgggtgatctggcatttctacttcttttgagacattgctatccggctccacagctgaaggtaaatcaatactctcgacaacctcttttgtgggcctattgctatgcactaaaagagccgtagcggatcctacaacgacaaatatagcgattccgataggaattattttctttctggaattattcttttctgttattggctccacggtaggtggattagccacattgacaacagtctcttcatcatccgatcctactaatttagaatctacaggtgatgaataaaccaccgttgtttcctcattcacaatctcgggagatggacttgggacaacctgaacttccttttccgcttgagaaaaatccaaagacgccaacatctcgcccaccgtctcaaagcgatccgcaggaatgatttgcatcgcttttatgataacagcctctgttttcgggctgatcgccgcattgatttcagaggggtttcgcaaaggacgtgcggcacgtagtatagattctgtagggattgttcccgttaacagattatacatcgtggctcccaaggaataaatatccggacggggcgagaacacttgtgttccttcgttatcgtattgctctatggatgcgaatcctttagaaagggttaacatcgtagtgctggtctcttcctgctcgatatcgtaacgtttgctgactccgaaatcgatcaagcgggcgttcccgttcttatcgatcaagatattgctaggcttgatatccagatgcaagatactcttatcatgaacgaattgtaacgcctcgccaatttgtcgtacatatttaaggaccgtagcttcgggcaatatcccgtttttctcaagcatatattttagcgagaagccggaaatatactccatggcaatataagccgtattgttttcctcgaaaacctccaacacgtttacgatatagggatggtgaacttccgataggatctttgcctctttgatcagtttttccttgaacttgttaaataagacctttcccgtctccgaatgtacttttacggcttgggaaccgggttctctataacaataatccttgaagaaatattccttgacacagatagggacctccgtctttacggtacctaaagatcctttaacctctgtgtaccaaactcctctgtaggttatgccaaaaccaccttgaccaaccacatgagtaagtctgtattttccgttttgaagaagatgtccgtctggcagattcataaccttgaataattccatttaatctgccaaaagtacgttatttatataaaagaataaagaaaagagagaatattttgcttaaaacccatgctatcttccactttttgaataggtatgatataaaaagaaaagttatcccgggttttgccgtcacaggcttccatgagggcgtcctttatttccggaacagataaacgaccattaaatatctctgcgatcttttcattcttcagtctttcaagaaccccgtccgtacaaagaaagaggaaatcgtcgggttgaatatcgttcaaggtaataatgtccgcttctgttggagtatgagtgccttgtatagcccggataatcacattccgctgggggtgggttaacgcttcttccggagtgatcttacctaatttaaccaatgaatttaccaatgaatgatcttctgtttgatataaaatctcccccttcctcagatgatagatccggctatctccgatatgagccaatacgattccggaagaagcgatataggccatggtgagcgtagtagccatacccatcgcttccggatgctcttgaacataggagtcgaaacagacttccgcataatgtacggctttatggataaactcaggcgtgggatcatcctttaggaacgtagaaaagaaagtttgtatggactcgcaagctaatgagctggctacctcccctttctcggctccacccacaccatcgcaaaccataaacaatttttggtcaagggtcacttgttcgggaagcgggtaaatggaatcctcgttattcgatctgcctcctttttccgtaatagcacatggcttaccgatcgttataatcataacaaatgagttttattcattaaaacgtaagacggtgcgaccaataataatctcgtcattatcattgagcacgaccacctcgccattctctaggtaactgttattatataacgtatggtttttactattattgtcggtaaggaaatgtttatatccaccttttgaatcttttttcacctcaatgcaaatatgctcgcgactcatcgtgcgatcagccgtgataattggcatcgtagcttgtgaggcgttcgacttccggccaatgacaaccttcccttcgtgaagaggaaacgcttgttcaggtgtatcgccgtctggaagaaccgtcagtctgccgattccagtcttgacaggtgtcactaaaatcgtatcggaatcgacttcctgatgattacttttctcggataataaggacaaaggaataggctctttgcatttcggacacttaaaggaggtaatgccgaggggaatcttcccctcgtctacctttaatcctacatggcaatgtggacatttaaccgcgatcatacgataaacgaaatatctgcgccatccatatccgtagagtacagatccatcatatctgtatcggaaagcataaccgtatcgtccgccaaggttataaagtctgaatgatcgaaagactcgatgctactatcgtctataactatggcgtcgcctaggtcgacacctcctccttccacgtctattatgacagcatccgctggcatgacgtcattgccgtctaaagttacgaatgtatattcctcttcttgcataacctttgttcctaatatattaatattccgaaaacaaaagtacaaaaagcaatggattaataaacttgttattctctcttataatcaaacatttgggtttcatgtacaaaagaggctgttttactatacgaaaagaaaaggctcattctctcacccatttggccttacaggaagaaactgggcattgctttcggtttttcaatgattcccaagggatctcacctaagaatgttccacatttcggacaaacatagtctatcttaaattgattggcgatatcctgcaattgctggggaattttggccgactgcttggctcctagatagattcctaccgtaggggcacaaatcgttatcaggaggctgataccgaatagttccgggctacctttccctaagaagcctatcacgacccccactattccgggcaaagcaaatggtaaggattgaaataatctggtcttaaactgattagaggattgaatcttaacttttgcttgaatataatcatcgtagacttttttcaatgcggcaaattcatcgctataatcattattgtatttaagcacctcggaaagatttaagacatagctatcccccaagcgaatatgatccgtaggagtaacacgtttctttacgatctgggctccattcacgaacgtaccgttagtagatcccgtatcctccaataataagttgccaccatcctcacgtatcagacgggcatgatggcggcttacatgaggatcgtttgcaataaaatcgttgtcttttgcttttcctatctttataatcatagtcttattccttttcctcttcctcttgaggctttcccatctccttctcaagattatctttcagcactttcaacggatccttggatattaccaactctttaggcttaccctcttccgtcaataataataaacgctgcttagggagatttatttgtaagatatgatttttatttatgatatgactttttccgacacgcattaatatcttgttacaaccagcgacctgcttctctaagatctcttctatttttccgatatttatagcgaaggtaaattggatgccatttgacaacaatagtttcgtatagttcctgtctgcttcaaaataaaggatctgaccaatcttaatgcgcaacaactcatcccttgtttttataattaaataccgctccatacgtagaaattgttttttcgtttctctttcaaaaacaaatatacggtattttctttatttaataggtatcttttgggggaaagattggtaaagtgcaccaaaaacaagagccttttccctgctcagaagagacaccgatacgccctcccagcctttcaattatattttggcagatagaaagtccaagccctatgccttgcttttggtttcgtcctttataaaaacgatcgaacacatgaagttttatttcctccgacattccttcccccgtatcggtcacggataaaagaacctcgttctccatggcttgatatgacaagatgatgctacctatagaggtgtacttaattgcgtttgttataaaattgccaagaacttgtttcaaacggatacggtcggagcgtaataaaaaggaatccaaagattccggataggtcaaagctacccctctcggtactttgatctggaaagatgctaccgtttctacaataagttgtcttagatcaaattccatgaaatcaaaggtcatggtaccagactcgagcttagccagatccaatacatcattaacgatacccaataataactcattattggtctgaataagattaatatactcttgtcttagctcaccatcctcttcatcccctaaaagagaagagaatccgacaatagcgtttaatggcatgcggatctcatggctgatgtttgccaaaaaggaggatttcaaacgctctgatttctcggccttcagcattcgttcttccatcgctttcagttcagatatatcataattcatcagtaataggatggggcttgatttctccagacccgcctccattatatccagacgaacccatttccatccctcgccatccctgacccggacttccccttgatcatgatcagtttctccgtggacaagtcggctcaaggaagttttcaagcattcacggtcttctggcttgacattggaatatatgcctactatctggctcaatggagttcccggaacttcacccatattcagataccattgttccatcgccactccttccccagtagacaaatcatactttgcgcagccgatcttggcacgatgacttatctgaggaaaaaaaggctcgaactctatgcctaatgtcgttttcatatatatccgttctcattatatttatgcaaaaagagggtttagccataaaaaacgaatgaattaatcgttcgttttaattagtcgtttatatcgattattttatagggaacatatacgcccggcaatcatctgatagatggtattgtcctctttggagaggaagagcggtttctcacccgtgacgagcagggcatggtggtctgtcaccttgccgtcgtccacgctgcggcgtgtcggggcggcttttgcccgcaccttgtctttccattcgggctgtgtgccgatgaaagcgagcagtttgggaatttcggcaaacacgtcttcggggatgtagcggcttcccgttctcggataggttatcaacttcttttcgtagagtttctgcgcgatttcaagcgtctgttccgccgtgaagccgtgcttggcgttggcttctttctggagcgtggtcaggtcgtagagcaagggagtttcctccgtcttctccttgcgctcggctttcgtgacagtggcgcaacctgccgcctttaccttattatatagttccatcgccggttctttctctttccatttctcggaggatgagaatttcacgacttcgccgtcgcaaccgtccgttgcgatatggagctgccagaatgcttcggacgtaaagcggcggttctcccagtagcgttcacataccatagccaacgttggtgtctgcacccgccccacggaatacgtgccgtgtccggcggcgatggataacgcctgtgtgccgttgatgcccacgagccagtcggattcgctccgcgctttggcggcgaggtagaggttgtcgtatttgctgccgtcttcgagtttccgcagtccctcgcggatagctttgtcggtgagagagctgatccacaggcgcacgaaaggagtggtgcaacccgtatagtggtagaggtagcggaagataagctctccctcgcgtccggcatcggtcgccacgatgatatgttcgcttgtgtcgaacagtcttttgatgacttttatctgcgacaccacgccgctgtcgggcttgtaacctttctccgtcctgacctgacgggggacgagcgtgaatgtgtcgggaataatcgggaggttgtcacggacaaatccgcgcacgccgtagccgtcgggcatggcaagctgaacgaggtgtccgaatgcccatgtcacggcataaccgcctccctcgaaatatccttcctctctctttgtcgcgcccacgatgcgggcgatttcacgtgccacggagggcttttctgcaatgattgtcttcatgtcttcttcttttttgttgatactttggattttattttggattcagtggcggacacgggattacattttcatgcccttgcccgttttcttctgcggcttctcctgctgctgttgctggcgggcgtccttcgggttggtctgacctttctgcaacggctctctcagattctttgtagcctcgttggtcttgccatcgttgttcaccgccacctgcgtgcggctctcgttggacggagcaacctgctgtgcattgtcagggttcgtgtcgtagcggtacgggcgtcccttctccgggttgaacttgatatacatcgtggcatggaagccctgcttgtcggtcacgttctccagcttcacggctttacccgccacatagtcggctttctgctggtcggtgaagctcacgccgctccatttgctgatggggcggatgctgccgtcctcgttcgtccacgtgttgcggcgttgctccttcttggtctgtgcggcattttccccgccctgcgcctgacttttcgatgtgtcgcctttggtttcctgtgtctgtgcggtacggggcgacttgccggttcccggcacgaactccacgccgcgctgctccacgttcacttgcagggtggtgacgaactttctgccgtcgttgcgctcgatgagcttgtcgcgtacgggcagtccggcgcggagcatgtcccgctcctgcgtggtgatttccgtcttgccgatgcgctccgggatgcgcaccctgcttgccggaatgtccgtgatttcattcgtcttgcggtcgatgctgatgtaggaggggatgatctcgcccgtttccctgtccacaatgtccacgaccctaccgagattgcccgtttcgcggaggttcttccggtcattgtcggagaatttgtgttccttgtactcatccagcttctgctccttgcggatgaagtgcggcacgaggctgatgtttccctcaccgtccttcttgaaggagaggcgggcgtccagctcgaatgattcgccgccgaaggtcggtttgacctttaccaagtcggacttgccatagttgagcatcttcgtaaggtcgccggacttttcaaggttgtcccgctttacgccccatctgtcctccagctcctgccagttgattttactctcgtcgatgggctggtagccacgtttgccctgcatctgttcggatttgtcctgttgctgttctttccgttgttccatgttctcctgtttttgaggttcttgtttctctgtctgttgtgctgccatctcttcctgcaccttcttctcatagtcggaggtgtccaccttgtgaggggcgagcagctccttgttcgcttcggggtctttcagcagttgcttcatcacctctaagagattttcagcttggtctgccgcaatgcggtagaaaccgaagcggctgggttccttgcactgccggaagaagttcttgaagaagttgtccagcacgtcgccatgtcggtcgaattgcaggaaactctgcgcgttctccgcttttgcgggggtgcgcttgggtgtgccgtccgcgttcagcccggctaccacgctgatctcgcctgtcttctcgtcacggactaccagcacgtccttttcgtcttttttctttgccatctgaaaaatgttttaatgggttatttatgaaagaaattatggatacgagccttgtagaaggctatatcttcctttttgaagtccttgatatggttggaaaggaatgtcagcacgtcctcctcgctgtaataggtcttcttgcccagcgtcttgtagggcaatgcgcctacgctgcggtagcgttggagggtgcgtttgcttatctggagcaacatgcacaaatcctgattgtcgaaaaggcggatgctttccgtgatagtgggctgtttcccctcagccttcatcgccagcagcagttcgtcctgacggtcgagccgttccatcagcttctgcatccagccctcgaagttgtttcgtgtgagcagttccatgacctatgtcctccttccttttggtttgccgcccgtgcgcagcgtgtggttgtggaacagggtgtctattgtcccttcctcgttccttactgtgttgtcctccaatagccgcagtatctcggaaaggcggtagcggcagcttccgcgtaccaccacatactcgatacggtggtcggtgcgcatacgctgcatggtgcgcttgctcacgttgagcatcttcgccgcctgtgccgtgtcaagcagcttgtcttcggtttcccgcttccgtttcttctcgtcccttgcctcgcggatgtaccctgcgatgttcgcaatctgcgccatcatctccttgtaggcggaactttccattgttatcactttcatgttcagtcctttctttttgtttctgcgacaaaattcggcaataaacaaaaggggctttaacaactcactacgtgactcacgtaagatttttgcggaagatggctccgtaacccggtcaaacggcgcaacaggcagcctttcagcggaaaacgatacgtcttgtatgccgtttcgttacctttgcggcaaactctaaatgacatgaatatggaaatagtatctatcgagaaaaagactttcgagatgatggtggcggcattcggcgcactctcggagaaggtcgccgccctgaggcgcaaaagcgacacggggcgcatggaaagatggctcacgggcgaggaggtctgcgggcagttgagaataagcccgcgcacgttgcagacgctgcgtgacaggcggcttatcggctactcgcagataaaccgcaggttctattacaagccagaggaggtgaagcggctgataccgcttgtcggcacgctctatccgcacggcagatgatttgatttattcacccactgaatccgaagttatgatgaacgagaacaacgatgtttttacgatggaagacgagccgatagcctctgtggtgcaggatatgcgcaaaggctcgaaatggctgtccgcatttctggaaagctaccgtcctccgctggacggggaacgttacctgacggacggcgaggtgtcggaactgctccgtgtgagccggcgcaccttgcaggaataccgcaacaaccgcgtgttgcccttcatacttttgggagggaaggtgctttacccggaaacggggctgcgcggggtactggaagcgaactaccgcaagccgctggagtgaggcggtttcatgaaaaagtaaacgggtgacaccttttgtggtgctacccgtttacttgtcttatggggtatgtgcaatcagcaatacccggcttttccgttctgtatgaacatcacgtatgtctgccgtttctcttgtgagagtgcctttcccaccagccatgtgcggaacaggtgggtgttgtaggtattcaccctgaaagcgaccgggatgatgatttcaagggcgtacacgtccgcgtgcagcccgttttcaagctgcatgtagcggcacacctcgtagtcgttcagcacgtccgacttgcggacggctctgatggcggcgttcactgccgggacggtcgtatggaacaatccggctatttcggtggcggtcatccacacgtcgttaccggttacgctgactgccttgtcctcgatgatgattgtgtcacgtttcatggcttttctttttagatggtgcaacctgcaaattcctcgacgccgttcaatcttgcggcaaggttctccatgtcctgattgagcttctctttggttatctttgcgtaaatctgcgtcgtctttatgctcttgtgtccgagcatggagctgaccgtttcgatgggaacaccgttggagaggaatatcgtcgtggctgccgtgtggcggctctgatgccacgtgatatgcttggtgatgccgcaacgcttggcgacggcacggataccggcaaggcacgtgttataatgcggaacgggaaatatcctgccgtccccgcacagtccccggtatttgccgattatgcggttggcgatgtcgagcaggcggatgttggacaccacgcccgttttctggcggttgatgtttatccactcgtgttcgtcgaagtaggtgcggatattctcttccgtaaggttgcgcatatccgcgaacgacagccccgtgaaggcgcagaacaggtagaggtcgcggtacaattcctgtttggcgtttttcagtttcccctccatcagcaggcggatctcatctttggtcaggaaactgcgtgttgtttcctccttcttgatttcatactcgcggaacgggtcgcgcgtcagccactcgttgttgatggcgatgaataccatcgtccgtaacgggcagacgtacagccacacggtattggtgcagcagtgcttgtccgtgcgcaggaacatctcgaagtcggagatgaaagccggggtaagctcttttagggcgatgtccttcacatggtagcggatgtcgaggaactcttgcatgtgcttgtaaacggtgcggtacttcagcagcgtgcctttggctttcatgcctgcctccacctgcttctcgtagtcctcgttgtgctggcggaacacctgcatcagcgtgtggtagcggtgttccagtccgagaaaggcgttcttcaccttctccgccgtgacgaagttgtcacgctccatgatttcctgataatgcctgttgatgcgtacccgcatcttgtcaagcatacggttcgtttcgagtgccgccgtgcttctgcccgtgacacgtccacctttggtgtcccacagtttcggatcgacagtcagtttgcagctgaactgtgtctggctgccgtccaccgtgatgcgtcccatgacgggaactgtcccgtcctttttcactacctgacgcttgaggtagtagattactgaaaatgtactcttcattgtccttaatttttgggtttcaaaattagttggtgaagagtccggtgttggtacgcaaaacggggaggaacggcgcaatctttttccgtaacctgatttttcgcatgagttatggataactcactattccttagagccttgtttcgctattcgtacccgtttgtcgcattttcgggcatggttacgaacaagtaacgtagcggcgtcaggatttggcttcggcagggattgtaatggcttcacggattatcgccacttcaaccaaaacccttgtaactcaattctatcactatatctttccgcatttcacttttttgtagtaactttgcaaagacaatttaattagtgttgtttgtgataagatgaaggaatgagtatggtacgaataagaaagatattgctggttgttgtgtctgcgttggtcgggatctttttcatacttcccttgatcggggttggtatactgaaatgggcggtcttacccccggaaaagctgacacctctggtcgtagagaaaacaaacgaatttattgaggctcatttggaatgtgagcgggtggagttgacttatttcgagacgtatccttatctgggagtgaagttgacgaatgggcgtttgatctcaaatctggctgaggattctatagaacatcaggaggatttgatgattccttcggattctttgctgtctttcaaaaaagcgatcgtcgtatttaaccctacggattatctgtttagcgggaaggtgacgattcctcgggttatcatggatagtatccgtttttatggttatgtgaatgaggagggaaaggcgaattgggagatttatcaaagtgagatggattcggtagatgaatcatcgtcatctccattgcctaaaatagatttgcagcaagtgcatattacgaatgggcactttgtctatgatgaccgccagcaggatttatatacggcgatcgatggtttctttttacatatagatggccttttgacccaacgaggaaataagttggatgtggagaccggttcttcctcgatcgtattccgtagcccgtcttattctttagcgaataagttagcgttacgtttcaagggacgtttgttgttggctgatggacttcgccggattgggttgagggatgcggagttgctggtgaataacctgccttttacggcggatggctttatggtgccggctaccgaggataatccgtcacggatcgatatgactttcgggttgaaggtttccgatatgaatgatctcttacattttattccggatgaatattttaaagatcgggataaaacacttgctgagggacgtattattttggaaggggatatccgtggggaattaggggatagtattgttccgaccgtgaacttatgctgcaagatagaggatggttcttatcatgtaaaaggtattgaacaggggatcgataccttgcgcatggacgtggatttacatttgaatggcgcttacccggattcttcttatgtctctttggaggagttgacattgatcgggttgaatacctcgttgaccatgagtggcgaggttagggatatctggaggaatcccgcgattcgggcggagatgaaaggacaggtcgattttacccgtttggctaaagagttcttgaatcccgacacactgctgctggagggtaccatgatggctgatttatctacggtgtttaaggtggatgatatcgtgaatagccgctttgccaaagtcaagtcatccggtaatttgacggttgatcgtttcaaggcgtttagcaaaccgttaggtgtggatatgtatatcgccggggcgaatctgttcgtaggctcaacagagaatgaaagtaaatatctgaatgcgaaaggcttgttgagcgctaatctatcggtggataccttgaatataaagtataaggatgagattagtacgaatatcggtggattgaagatggtagccaacacgacgccggttattgatacaacggctgttatccctatgaccgcagggttggaatttgatcatttacgcaccaagttgccggattctacctggatggtggccggtaagaccgtgttgaaagggggcatcaaggcttcttctacagataagcggatccctatggcgggagctacgatctcggtggacaccttaaaatatattcttatccctttacggacgggtatggttctgacggaaagccagttctctttggaagcattaccttatcggcaagcgatccgtcaacaacgtgaacgccgtattaccgccggtgataccttgcgcaggcgcacgcggaccacccgaagggcgaatagacagcggtcgcaagtggattcggtcgcttcctcaaacagtgtcttacgccaatgggaggctcggggacaagtgaggtttaagcaattgaggggctttagccgcttattccccattccgatgtatattgatgagacgagcgtgaaattcaatactaacaatatgacgttgagtggtgcccgtctgcatttaggaaagagtgatcttactttgagcggaaagcttagcgacatccggcgagccatgttacggggaggaaagctgaaagcgaatttcgagttggaatccgatctgatcgattgtaaccagttgatgctggctataagtaaaggtttgcagttttctgatcaattggcatccaattcggttggggccttctcggaagacagtatctccgtactggagacggatcatctattagcgaataccgtggatagtgtcgctacggattcgatctctcaactatttgtcgttccgaaattcttggatctgacgcttcatacaaatgctaaaaaaatagattttaaggatctgaagttggaggatgtgaaaggtgaggttgtaatccgggatcaaagtatcaatctgagcgatttatgtatgagctcgaatatcggttccggagatctgacgatggtttatacgaccaaaacagatcaagaggcgactatgggatttgagttgtccttaaatgatattttagtggaacggttaatcagtttattcccggatatcgacacattggtccctatgcttcgttcgttcgaaggcatggtagattgccagatgacggcgacttgcaaggcggattctacgatgtccgtgttgctgccgtctgtaaatgcctcttgctacctgagcggaaagaatatggtgctgctggatggtgagacatttaccgagatatcgaagacgctgatgttcaagaataaaaaacggaatatgattgatagtatagcggtagatttagcgatccatgataacaagatcgaggtattcccattcttggtggagatggaccggtataaagtagccgtaggggggacgcataatttggatatgacgttcgattaccatctctcggttttaaaatcgccggtaccgtttaagttgggtatcgatataaaagggaatctggatgatttcaagttcaagatagtgaaatgtaaatataaagatttcttgaaacctgccaagcaagcggaactggatagtacccgcaggaatgtgcgtgaggagatacgcgagacgatccggaaacaaataagagaggccgctcccgaattaggaaacagcctctctgagattcatccacatacacacggtcacgttgaggaatcaacgtgatccatacatttgctcgtaatatttcatgtaatctccaccggtgatatcctctacccatttttggttctcaagataccaacggatggtttttacgataccgacctcgaagcaggtctctggtgtccagcctaattcgttggtgatcttcgtcgggtcgatggcgtatcgttgatcatggcccagacggtcttttacgaatgtaatcaagctgtcgttgatccagtcgatagagatttgtccatcggcaccgatctcttttttctttaatacttggcgatattccggttgttcggtcattagttgatggatcgtccggatcgtgagtttcacgatctcgatgttctgcttctcgttatgaccgcctacgttgtaaacctctcccacacgcccgtggtggattacggcgtcgatcgccttgcaatgatcctctacatataaccagtcgcgtacgtttgtgccgtcaccatatacaggtagggatttaccttccaatatgttctttatgattaagggaatcaatttttccgggaaatggtaaggtccgtagttgttggaacaacgggtaatagataccggcatcttatatgtctcgtgataagcctttacgaataagtccgcgcttgtcttggaggcgctgtacgggctccggggatctaaaggcgtggtctcgtggaaatacccttcggcaccaaggcttccatagacctcatcggtagagacttgatggaaacgtacaccttcacgccataccggataacctgtctcggccttaccggtaacccatgcttttcgtgcggcgtccaataggttttgtgtaccaaggatgttggtttgcaggaatagctggggattttcgatgcttcggtccacatgactttcagcggcgaagttcacgacataatcgaagttgtatttctcgaatagctggtcggccaaagcacggtcgcaaatatcgcctttcacgaactcgcaacgtactccatcgatatcctcggcgatggtgcccaaattacctgcgtaagtcagcaagtctaggacaacgatcttgatatcgtcatatttcgccagcatatgtttgatgaaattggcaccgataaaaccggcggcaccggtaactaggtaagttttcatatctgtacagtgtttagtatttgaaattaagctcagcgtctttcagcgatggagccttggtgtctttctcggataggttgatcgattccggatctgtgatgctccaatctacatggaccgtgggatcgtcatagcggattccccgttcatgcgttggagtatatggattatctactttataggtaaagatagcctcgtcacttaatacatggaatccgtgggcgaatccctgtggaataaataactggcgtttattctcgtccgataactctacagctacatatttgccgaatgtgggcgagccttcacgtacgtctacggctacatccaatacccgtcctttgatcaccctgactaatttagattgagaatagggcgctagctgatagtgtaatcctcgtaatacgcctttagaggagcaagattcgttgtcttgcacgaactggatttttccgatatgctcctcgaattccgcttgcttaaaagcttccataaagtatccgcgcgcatctttcaatacctttggctcaatgatccatacgcccggtattacagtttctgtataagtcattttttcgttatttatctatttgataggcaaaggtaagctcattttctctacttctataatattcggagggaaaaataaaaaagaaaggaaaagtttggtaattccaatattattctctttctttgcactcgcaaaacaaaagtagttgttttgtgttgaagttatggttccttggatgagtggcttagtcagcggtctgcaaaaccgtgtacggcggttcgaatccgccaggaacctcttggtaattgaaaattcagtattaagaattgaaaattacttttatttttgattgattcggttccttggatgagtggcttagtcagtggtctgcaaaaccatgtacggcggttcgaatccgccaggaacctccaaaagtaagaaaggattagaatgaaaatttctaatccttttgtttttcagctacttacgtcctatgtggtggaaggattggaagaagaattttcatagttttcagcttttgttttacaattgttttacagtaaaacagcgaagatttgtaatgaaagctacgattaagattgagttgcgcaaggattatgcaaccaaagaaggcaagcaaatggtttgcttgcgttacactgcctatcgtcgttctactttaattagtatgaacatagcagttttacccaaacattggaataaggtatctaatacggtacgtagttctgaaccccattgttattattataacaaagctatcagcgaagtatatcaaaaggctgatacgattgtaatggagaatttcttcactccgttacctattcctcaatttttggaacacttgaaagataagcatcacggaaatacggatttctatgttttcatagagaacgagatagaacagctaaaacaatcccgtgcatcaggtacgattgcaaactattacaaactaatcaatactatgaaggaatggaaatctatcctttctttcaatgagataactttggattttattcagcagtttcataaccatgaacttgaagttggtaatatactttctactgtttataaaaagcattctaatctgaaatttcttataggcattgctgttgataaggaaaagctggcaaagaacccctatgaaaaatttgaaattaaaaaaaatatcaaggcacagaataatgatgtactgacagaagaagaacttaaaaggctacaaagtgcatacgataagaaagaatatagtaaaggaaagcaagaggtattaagagagttcttgtttagctgttataccagcttgtcatttgccgagttctccatccttacctattcggacatcaagccgattaaagttgatactggtgaaacttaccttatattgtgtaatgaacgtacaaagaccagtgtaacctacaagattcctattgtttcgcctgtagtagtagctttgcttgggaatggtgaaccatgccaaaagattttcctacctatatccaatcagccgacaaaccgttatttgaaagatataatggctgatttgaaaatagacaaaacaatgacatttcatcgggcacgtcactctttccggacgattgctgcccaaaaaggcattcgtgacggaatagcagagcgaattatgggacatgcagaaggtaatgacatcaaggatatttacacacacttgcatgatgaagatattgtgaaagaaatgagagataagtggataatatagggctggcgcattttccgcactttccgcatttttaggattaacttcatgtaaattaatgatttgataatgcgagtaaaatgcggatgagataaagttgacgaaggaagaaaataccaattactttttttcttttcgccagtatttatctctctgtcaatctaaataggtttagtctgttttggatataaagataaaaaatcatagaacaaagcttataagcgattgaaattttcttagtacttttgtagaaaagattagtttatgaaaaactttaatcaaaaatttgcggaacatccagagctctctgtctttaaagagttttttttatcacatggaaagtctaaagagataaagaagaaagaatatttggtagaacaaagttctgtagctaaatatgtagcatatgtcgtagagggctttttcagatatacacgaatagataataggggaaatgagcatattgtaggttatgtctttaaaggtgaatatgttggtgactatgcttctcttataaagaaagatataacttctttggttacagttcaggcagtaactgattgtaaaatatactatgtaccattagaagaagttagaaagtttttcaatacgaatgaagatgcacaaattgcaggacgtgttcttgcggaagagttattcatggtggcatacacacgtttattagatttttattgtaaaaacacagaagaactatacatggacttaactgaaagatgccctgattttcaaaattatataacattaaaagaaatggcttcattcctacaggtcacacccgaaacaattagccatattcgaaatagcattaacaagaaacatatctgttaaaaaaacttagtaacgtcttcatatcatacgagccttgaaataattcaaggctttttcattttatactgcttttctttgccgaaaatattagaaacatgaaagcaaagaactcattaaaaacacttttgttctttatctgtctcgtcagctttgttagctgcgaaaaaaatgaagatgagaatgagtcaaaagaaactggctatcaagagtatattttaactgttgcatcacaaaagctacaaggtattgtgggtattggcgtcaatgttttaacagatgtgtatgctgtaaaaaaggataaatcacaagaatggaagcggtttgcagacatacaagattttgattataagaatggttatgaatatgtaatcaagataagcgaaacaaactatttagattataggcgtggcactcctgcatggagtgaatataagcttattgaaattatttccaaggagaaaaaaggctctcaagggcttcctgaaaatttcataccaaattggtggcacactaattgaaagtcttgaattatttcagggcttttttgtttgacacacattcatagataaagaaaaacttataaatatatagattatggaaacttataaaggaatagcaattattacaggagccagtcaaggaataggcgctgtagttgctaaaggtttagctaatgatggttatcaggttgtattgatagctcgaaacgaagaaaatttaaacaaagtatgtaatgaaattatgctattgggaaagtgtatacagtccccaattatactacctttagatttaacagatagtacaaaagtagattgtgaacttaggaacattcatcaaaaatatggagatattgatattcttgtaaatgctgccgctatgttcatggacggctctttaaatgagtccgttgatgactataggaagattatggaaattaacgtaatagcccaatatagtgttttaaaaattgtaactgacattatgaaggcacaagggaaaggctatatttttaatatagtatctcgtgctgccaaatatgggtttcctaacggtggtatttatggttctactaaatttgcctttttgggtttagcagagtctttatatcgtgaattagctccgttaggaatacgtgtaacctctttatgtcccggttgggttaatacagaaatggcgaagaaagccggaactcctttcaaaaatgatgaaatggtacagcctgatgatattttaaacaccattcgttatttactaaacttatcaccaaatgtatgtattaaggatattgtttttgaaatgaaaaagagtatcatataatttttcaaaaaatagcatctaaaagattagaaagcttcaacaaaaaaaatcaagtctgatttatgttgaagcttttactataaaacattcgatttatgaaagaaaaaacaaagttgaatataggcttactaaatgtatcattaggaaatcttatagtcggattattcattgcagatacattaatactaaaaagcatttcatttgctattgcatctatatgtattggactaattccgtccaataagatttggaactatatcactattagccttttagcaataataatactcgtattctacatcacaaacaataaatgaatatcaaataaatcaacattcaattattatgagaactatgttagagcaaagtttcttccgattactatcggaatgctcccaatgtaaagtatctgtaacagagtttacagaagctattgaagaattagctaactatttagccgatttcagtactaacgaacaggataacagcgttttactacgttacctttctttcggattgcatagacttaaatcgtaccgtgtgcggtttgagcaagaaaaaaatgccttatttgtatctcattgatgaagcgataggattactgaacaacgaaatacaccttgttgaatggcgtatcaagtacccggaacaattcaaaccacactttaacaaacaacctttttcccctctctatttggcagacaaaacaaatctgattgatataatggaaatcatcagcggtctgttcctctccaaacgtatcgtctatcaaaatggcaaacctgctttcctctccgacttgtctaaagcatttgagtgggtgtttaacattcaactgaaagactatcatcaaaagcatgaggacgtaataaagcgaaagccgggcaaactgaccgaatttcttaatggactggctgaccttatccgaaacgaacataacaaaaaaggatatagataatcagtgacttatgacttatttataggggactccatgtgttaccccgtaaattctttgcgctggttttctgaactttgcttcatcaatcgattgacaaccactaaagtataatctgaaaaatgaagcaaatatgtatatagaaaactatgatttcaaggaatggatgcaaaagctatttgataaattagatgggctttgcaaggatgtacgggtactgtgtaatgcagataaggtgctacctgaagatgataacctgctggataatcaggatttatctctactattcaaagtgagtatcagaactttgcaacgactacgaagcaaaaacaaacttccctatatgttgattagcggaaaagtctattaccgggcttcggatgtccgggcattcattaaggaacggtttaatgcggttatgctccgtaactttgaaaaacagttcggggaaaagaagtaagacaaataagccggagtagtaggtatcacttgctccggctctcttttctatggcttccttaacttatccgcttccttttttaactgtttggcttgctcgtccaacagccttgcacgttccaacgcttccgcttgcttacggctacgatattcaaaatctataaccgtatctgttatgctttgaataaaagcattatcccgttttcggctgaaattcatttccagcaaatctaaactgcttccgtctgcctttcctttcatcaggagataacggtattttatatcattatcttgtaactgctgcatccgttccgcaaaacggatattcagacctaacgacacaaggctaatgactattcctgctgaaaaaagaaaaaacttcggttgcagacaaagagtaatccggtttaggattttgtcatataaagaactgggttctgccttttccgattgttgtgtgtcagccggaaacaatatctttagtttctccttgaaatacctgtgtgaagctacgataagcccctttatatcttcaaggtcttgtttctgattctcggattgtcctttcttgatactggtgatttggcttaaaatctcctgcactatgttttcagtaatagcaggctttccctgtaattccaaaatacgctgctcgataacatccaatcggtttatcatttctttccggctggctggtgtcacctgttgttcctgcttctctttcagttccgtaaccatagagagaagcccctctaaaatcaaattctcttccatacgcttataacttaaattgtcgtttctttttcttcttctttctcaaatcgggattttcgagtgtttcatcaaccggagaggacgaaacggaaaacagaccgcctaaacctgccagtagcgaattatcacttttgtttattgctggctcctgtgtttgtgcggtaatcgtttgcttgttgcttccggctgttgtcagtcctgcatccccgaaatatttatccagtttggaataactgaaactgcggtcaatctccgagcctttgaacgtatattcacctttggaaaaggaaacaccctgtatttcatccgtctgccctttgtatttgaactgaatgccgatacccttttccgttaattgctcctttaactgttgccagttccttaattttccgatttcattctttacagccgtgtaaatctcgtatttcgttttgtccggttcttttagacggtgctgtttcacctgttctttccctttggcaaaatacaatccgtgtttttctttcagcttcttgcaaacttgctcgttccggtacatatcgttactgtctgaaatggttttaccgttattatctatccggttgaatacaatatgcacatgcggatgctcccggtcttgatgccgtacgatgatatattgcgtatcggtgattttcatttcacgcatgtactcctgcgccaactgtaccattttctcgtctgtcagtttgggagcatccactaccgaataacttagcgcaatatgtccgactggctttttcaaaccgggattcatttctgtttgcatacagaaactacggataatgtcctgcttgctttcgactaacactccctccgcatgaagcaaagctgcctgttccttgccaagtacatagttcacacagcctttaaatccgcttcccttttttatttttccaatcatccgataacaggtttatgatttcaatcatcctattttttagtttcacaagctccacagccacgagcgcaaaacctcctgcattggcacgatgtgcaagctggttgaggttgttggcttctccggctaacttgcggatagtgtcggcatcctgtttatttagccggggtgttacctctgccgaaacaaccgcttgccggacgtattcgctaataggcagtccggattctccggctcgcttcttgatggcgtagtactgtaactctgtcagcttcgtactgactacccgtttttgcttgtctatccggttctttgccgggcgacctcctgacttgtttcttatctctgtcatacgtttttgctttttaggtgctatcttagaaattgcgaccaacgggagaaatttctctttgcgatgagcaaagcaaggggtttcggtctaccgaaacataaccttgctctcctaaatcacattgcttgtcgttggtgtgccttacctgttctcttgactacagacgtctgcccctttttcttttttcaccgggaatctgtctgtttttctcttcttgattcagctgcttggcagactgtgtttgcttctccggctgtactggtttgctcggctgctgcatcctctccgttggctggctggacttttgacataggtagtcgttcaagtctttgtgtccgctgtacaagtgtgaagcatcacgcacacgccagtcgtattccttttgtatggcttgggtggctttacgtccggcttcgtcattatccaaaaggcagtgtatcctttcgtactcgcctaacgggtataatgctttatccacattggcggtcgagttcaggataatataatcctgccagtcgatacagggataagtcgggctattcttatggcggatagtcaggaaagaaagatagtccataaatccctcgaacacgaaacaggcattgttcctttttcctgcaaactgtatgcgtgtaatgtctttgggagaggtgcagcccttgtagccgggattgcgtagttcgtaccctcctgcatcgttcttgaaagcgagcgcaaaaagcggttttccgtttacacagtaatacatttcctgcacatagtctgacactacttcgggcgcaatgttccggcttttcagatagttaatgagtgccggattctgtaacggctggattttacggatttctatcgggctggcaagctgtttcttttcttcctttgccgcattcctttctgaaatacttttcccttgaaaagaaaaagtattggcagagtaataaccctgttccagtcggctgatagccccgtaagcattgcagctgtgttgtttcatcacaaggtcaataagcgagccgccttcgcccgttccaaagtcacaccaaaggtttacaccgtaatccaccttcaaactgggtgtatcgtcctgcctaaacgggctgtggtacataccgtaataaagtttatccactacgggcaagatacccaatgaatccaaatagtctttgatacttatattgttagcttcctgataagtcataatcattatattcgccattttttacagtggcataaagtgtggcgatttctacttttatgcacacatatacattattgataatcaattgataataagctaaaatgtggaaagtgtgagaaatgcggattttatcaaatcagcttcttatattttccatgtttgacattttcaaatagttttcctttcttgtctgccaaaaaacgtttgaatgaatctattgagatattttgcttttgagcaacagtaatgccttcgcttgtggaaaattccatcggtaaggcactatacaacatgaatttatctgtgggcaattgctctaatacagccgatgagtttgttatgtcctgtaccctttttgctgtaatacggaaatattcaacgattgatattgcaccttctacgcttgtacggtctattacttctttatcgctttcatcacaagcccatcgtgaaagttgtaatatcaaactaaaacggataacatatatatccagcttgctatatacgccaactaatacttcatccatttcgctattgcataaatctgtattcttatgctgccaatgataaagtagtgtacgggcttccgtattaaaaggaagctgggtaggtacaagttctccatcttcatcagtaatacactggatgcctgtcaacttctttatgatggaatcccaaagaggaactatgtgtgtggatagttcaagctcgttccaatactcttttttcaggttgggtggaaagacaaacaaaatacggtcaataaaaccgttttcgcttctttctcctttagccagttctttgagcagccctttttgtatcgtaccaattacagatataaaagagtgtttgataaatgcagagttcttatttccctgcctgtcaagtatgataggtttcccactgaacacggatagccaaaactgttcttccgaaccgctattatagcgattgaagttttttagccatgacatcagttcgtccacatataggcagattccccttttgttatcctgatggatggtgataagccgttcaggagtaatatccgatactataaactttttcaatatcggttctgctgtttgctccttatcttctttctcttttttacaagcaagaatgtatttttcatattctcttcgctctttctgatattttacggatgatttaatatccagttcaaacaatggctgcatggcaaaactaagcggatggctcttgtttactcctgaacgtccgatgattgccatgtacaagatggcacgttcattccaaccttcctttaccttcgctacaaaattgttgccgatacctacggataaggtaaagcatatagcggaagcaataaagtctataggatagttcagagtggctttcgtttcgtttataatttcccttatcaatttaggaaatacagaaacaggaaagctatcttcctcttttagctctgatatgcagatatttgtttctttgggtattgtcatgtcagttccttgttgggtagcgtccctttgtagaaacgctaccttgctctttcaagtggtggatgaaaaagaatttttagttcaacttttagtttagtaaatggctttacttgttattgtactctttaatagaactctcaaaaatacggttatcagcagtagcctttagcacgcctgatgccacaaggtctgaaattttcttgtgtgagcgtcccatcattctggctacttgattaatactataagtcttctctacatccgattcaggaggctttggcaacttcttatccaatactctttccattatcttttcgatagcggattctgtagttacaattactgtttccatacttctacttttttagttagaaaatctgtttattatttgaacactaaattttatttcttatctttgatgctgcaaatatagaaataatatatttaaagctaaactaatagtttagtatttaacttttaaatacacttatatggttcatcttgaaagaataaaggaattgtgcgaaaagaaaaacgtaacaatgaaacaggctgctgttgagttgggcatgacagagcagagcttgcacaaaatcatcaaggcaaactctactaaaatagatacattattaagtatggctcaatactttaatgtagaacctgcttatttctttgatagctattctactggcacatcagatggtgtttgtatcagtaaagaagaaatggaagggcttattaaaaaggtgatagcttactcgattcatggctttggaatggtgaaacttgaatgggatgctaaagaacaaaagtttaattcctatttcgatgtactaaaaaaacagtatagtcctgatgcttcggatttaaagtacatttcctctttactggaaacagatgttcatatcaccgacaagacaactcctaaagatgtggcacgggtattgatgaccaaagatgaatttgatttcacttctacctattattacggcatccgaaaaatggaagtacaggaagaacttcaaaagctcacagcctttttggataagcataatattcctatctctgattccattaagaaagatattgatgaacttaaaggcagggttaagtattatgaaggtaagagtattataggaaataacaagatttgaccataaactatggaacagatatttaataaagagcagcaggaaaaggcgcaattcattttgaatcatcctttggcaaagctatcggatttgcgctcaaatgaaataaaggatttggctgtggtatggtgttactattccggtaagatagaaggtaatacctatacttatgtggaaacagaagcattgctcaaagatggcattacttccgaaaagaagtatgaggatgccaagatgttgaagaatttatataatactttcatctctgaactggagtatatcaataaagggaaaaatcaggaagtgatagatgagcgcactttgttcagggtgcatcaatctatatctaccgggttggtttccgatgaagaatcaggttatttgagaacgagagctgtccgtattagcggtacggaatatataccgccaaaggatttgcatgacattcgggcaaagttgaatgaaatactctatcaacaagaacaatttacaattccattggagcgagccgtttatcttcattgcaacatagccaaactacaacctttcattgacggaaacaaacgtacctcccgaatgatggaaagcattgtattgatgaacgctgatattattcctgtttattcttcaagggatgccgatatactgaattacaggaaagggctgattggcttttatgaaacaggaaattattctccgtatgccgattacttcctgaataaacaagtggaacgaattaaagaaatagagtaaccatgaatgaaaatatgaatgttatgctgaaagaggtagatgttcttaaagaacagctatcggctttgcgtccattgcccgaagaagctttgaaaaagattcaggatgctttggatattgaatacacctacgaaagtaatcgtatagaaggcaatacgctcactttgcaggaaacagcccttgtggtaaacgaaggcgttaccatttccggaaagtccatgcgtgaacatttggaagcaatcaatcatacagaagctatcagctatattaaagatatagccaaacaagatatagagataagcgaacgtaccatcaaagaaatacacgcccttattcttcatggaatagaccgggaaaatgccgggagataccgcaccgttcctgttatgattttaggtagtacgcatatgccaccgcaaccgtatctgatagagaagcaaatggaagattttattctccgttttaagcaaatggaaaaagaaaaggtacatcctgttcttattgctgcctacctgcatgacgagctggtacggattcatccgtttatagatggcaatgggcgtacttctcgtttgttgatgaacttataccttcttcgtaatggttacgttattattaccttgaaaggtagcaatgatgcaaaggtaagctattacatggcattagaaaagtcacatacggaacatttgcaggaagactttcagaaactggttatcgaagcagagatagttgctctacagaagtatctgtctatcatggcttagacgtaccctttaggaagaaatagaataaatctttccattttttctttgcaaatcaaaattatcagtttatctttgtgattattaataaacgatttaaacagaatatttgttttacaattgttttacagtagcgaagctaaagatattctaatcaactggtaataaaaggattatcttggcagtttagaatccgccaggaacctcggaggaaagcctcgaagttgtttgtaatgaacgcttcgaggctttttttgttttgtccgtccggaaccctcgtcgggttgtcgggcggttcgctgttttcatggcttcccttggccggatccttagggggatttgtggttttcctcttgaggtattcatcttctaatggctgttgcatgattgtccaccatccgttgcatgatcatgcaacggatggtggacaattggacgagccgacaatcaatgagctttcggtattgatcaagaacaatccgggccatagcctgttatattttaaggttgtcgatggggaacataatatttccctaaatctcttctcccaaaatatccgcttaaacgtgacccgtgagctggtagactttttacaggagaacgagaatatcgattttaaaattaatggttaaagttgtacgacgctgaaagaatttgtacttttggcgtcataacaatcattagattataattcataattaaataatacgtaattcaaaatggcactacaaattacagacgctaatttcgaggagttggttaactccggaaagcccatggttcttgacttttgggcagagtggtgtggcccttgccgcatggtatctcctatcattgatgagttggcaaccgaatacgaaggtcgtgtgacgatcggtaaaatgaacgttgacgagaatgacgatgtagtcggacgattcggtatccgcaacatccctaccgttcttttcttcaaagacggtaagatggttgataaagtagtaggcgctacggctaaggataagttcgtagaaaagatcgaggcaatgcttaaataattgaaagttgagaattgagaattgaaaataccgaggaatacgctctgtaactttcaattctcaatttttaattcccctaagtatatgtcgcttgcccggaggaccgggaagacggctcatctcaaaaccagccgcttgcatacctctgcgtacctctccttttgcgcaataggttacgatcactccgcccggtgcggtatgggcatacaaacgattatagatttcttgattccacatctccggttgtttctcaggcgcaaacgcgtcgaaatagatcaaatcgatatcatccggtagttcacaggcgttactatttccttctattttatgaagtgtaaagcgctctgagattgaaacgggagtattccactccgcctcatgcaaggctaagaataactcttttctctccggccagatcagctccccataattcaaggcacgaatcgtatctaaaggaagcgggtataactccacggtatgataatcaatatgatgtgcttgagatagctcgacatccttcaatgtcaagaaggcgttcagccctgtaccgaagccaacttccacgattcggataaagtatttctcctgcgcatgcaatcccgcctcaataaatatatgtctcgattcctgcaacgccccgttcacggaatgataatgttcatccatcgccggaatatatagcgtatggcttccatccgccgttatctgtaattctttctccatatgtatgcaaagataatacatacgaatcagaataatacttatctttaccgctataaatatgatataagatatggatagacgccatctttacttcttactattcttattatgtaccatacaagccgctatcggtcaacagcgctccttctctatcaagggagttgtaaaagacgcgtcaagcggacagccgatacctttcgctaacgtagtggtatggaacacgacgcaaggggcggtcaccgattccaccggattattcgagatatccggcatatcacccggaagctatcgtctccaatcctcctttctgggatataagcccttcgttaccgccgaattcagactagcgaataaagatatattcttcccgatcgagctagaggaagccagccagaatctgcaagaggttagcgtagtagcctctccgttccgtaaaaccgccgaaagtccgctaggactccgtgtaatcggtttcaaggagatagagaaaagcgcgggaggaaaccgggacatctcccgggtagtacaaacctttcccggagtagcgtccacggcagcgtttcgtaacgacttgatggtaagaggaggaggtccctcggaaaaccgtttctttttggatggcgtagagataccgaatatcaaccatttctctacccaaggagcctccggaggtccggtcggtattatcaatcccgattttatccgggaggtcaacttttattcggccgcattccccgcatccaagggaaacgctttaagttcggtattggattttaaactacaagatggaaataaggagaaattctcattgcgaggagtcctaggagcctcagatatcggtgtgtccgctaatggaccgctaggaaaaaagaccactttccaagtgtctgttcgtcgctcttaccttcaattccttttcgatatgatcggcttgccgttcttacctactttcacggatgcccaattcaagattaagcactccttcaaccccaagaatgagcttacagttctcggattaggggcgatcgatgatatgaagctgaatacaggaatggaagacatgagcgagaaaaaccaatatatcctctcttacttgccggtcgtaaaacaaaaaacgtatacccttggagcggtttataaacactacgccggtaaaaatctctactcggtcattatcagccgtagccagaccaacaataagaatattaaatacaaagacaatgacgaaagcaaggaagagaatctctccttaaattaccgttcggatgagatcgagaataagttccgaacggaaaacacgttccgcttaccattcattcaattgaatgtcggaggaaacatcgaatacgcccaatacacgaatgacacctatcaaaagcaatttacctctatcccccgtaccatcgtatatcaaacagaccttggcatatggaagtggggtatctatgccacggctatttatgagagttataacgagcggtttaccgcctctttaggtgttcgtgcggacgcaaacaattattcctcggatatgaataatttgttagatcagttatctcctcgcctatccttatcctaccgcttgtccgatccgctttatataaacgcgaatatcggacgctactacgagcttcctccttatacgacattgggattcaaggataatgaaggtaattatgtaaaccggacaaatcatttaagctatatccgaagcgaccaagccggattaggcttggaataccgtcctacctcatacttgaaattcacggccgaaggattctataaacattatgatcgttatccgatgtccatactcgacagtatcccactcgcgtcgaaaggtacggactatggtgtcttgggaaatgaggccgtatcgtctactgctacagggcgagcttatgggcttgagatcatgggacgttggtataattataaagggcttactttcatcgcgtcctacactttggtaagaagcgaattcaaggatgggagaaatatggacacttatcttccctcggcttgggacaataagcatctgttcacgtttagcgggacttattctttacccaagaactgggacgtaggcgccaagttccgggtagtaggaggcgctccctatacgccttacgatgtagaaaagagtagttatgtagaagcttgggacgctaataacgggctatactatgattacagccggtttaacagcgaacggctcaagccattcacgcagttagatatccgtatcgataaaacattttacttcaaaaagatcatgcttggagcctatatcgacatccaaaacatattgaattccaaatacaaagagcaagacgtatatatcaaaacgggtaaaattatcaacccggaagctcccatatatgaacaacggtacgaattaagaccgatagaacgtcttacaggaacgcttctcccaagtatcggagtgatgatcgagttatagattttaggcgtaatagattctttttattttgaatttcagcaattaatcataaatcttttctatttttgtggactgtatgaacaaaaaatagtactttaatcgcaaataagcacatgaataggtaggtaaagaatgacattattaaaatactacatacgattcgtactctttatcgtgttaagtctggtcttttctttccacttatacgctacagataatgcaggccctattttaatcattagctcctacaatcccgatacacgtaatacgaccgccaatatttccgagtttatggaggaatataagcggggaggtggtatctcgccggtggttatcgagaacatgaactgtaagagcctcccggaagcccccttatgggacggtaagatgagaggtatattggataaatataaggaaaataacactcctcagcttatcataatcttaggtcaagaggcatgggcttcttatatctcccaagaatacaagcctgatataccggttttatgcggtatgatcagtaagaatgcgatcttattacccgactcggatttaaatgtcgccgaatgggaaccgaaatacatcgatatccaagagtacgtagataaaggtttacaccttggcgggttcttgtattcttatgacgtaaaagaaaatatccggttaatacgtaagttatatccccaaactcaaaatatagcattaatcaccgataatacctacggtggtttagctatgcagaccttggtaaaaaaggaaatggaaaatatcaaggatctgaacttgatattactggatggaagaaagaataatatctacaccatcgttgagcaaatcaagaacctgccggatcagaccgtgatattgattggtacatggcgtgtagacgtgaacgacgggtattatgttggaaatgccacgtataccatgatgaccgccaatcccagaatcccgacattcacattggcatccgtcggcatagggcactgggccatcggaggtttcagtcccaaatacaggcctataggttccgatttagcgaaagaggctttaagtatattggagaagaaaatcgcccctaaagatatccatccacaaatcattcccaatggatatatgttcgacgcttcaaagatcaaggcttttgatatcagcagattgtcattgccccacgacgctactattatcaacgaggacccgagcctattctccaaatacaggttcgagatcttgctaagcgtaatcaccgtattgtttattttcctgataatgatattaatcttctttatccgaaccaataaactgaaagataagttattggatctacagaaggataatatactaatcatgaataatatccaagcttctatctatttcatcaagccggattataccgtaaaatggagaaacgaggtagagttccatgactgtatccctgaattcggtccggctaattgcttcttggtcaagaacggagtaaagccttattgtacccgttgcacggtcgcaaaggccatggaaaccaaaaagcaggtcgatatcacgaatgagttcggcgatggaaagtatcttcatattttggcgaaccctgtattagacgagcacgacaaccttatcggggttattttcaagaaagaagacgtgacaaaacaaaaacaggcggagaacgaactgaggaaagcgaaagagaaagcggaagagtccgatcgtttgaaatccgcgttcttggcgaatatgagtcatgagattcgaacgccattgaacgcgatcgtcggtttctccggattattggccgtaaccgagaaaatggaggataaagaggaatatatcaatatcattaatagcaacaacgacctgctattgcaattgatcaatgatattctcgatctggccaagatagaggcgggtacgctagaattcgtggattcagacgtagatgtcaatcaactattctccgatatcgagcagtcttcccgtttgaaggcgcaagatggtgtgcaggtatgctttgtcgagaagatcccgaattgtatcttacgcaccgaccgtaaccgagtctcccaagtcattacgaactttatcaacaatgccatcaagttcacgactcaaggtagcatcctgtttggctaccgccatagagatgatgagttgtatttctatgtaaaagatacgggatgcggtatcgccaaggataagatcggtcaagttttcacccgtttcgttaagttaaatagctttgtgcaaggaacggggctgggattatcgatttgccagatgattatcaagcgtctgggtggagatataggggtggaatcagagcaagggaaaggttctacattctggtttacgttgccctattcgatactagagatgcaggaagtcccgcatgagaaaccaaagaccgagaatgtacagaagagccagtcatccaaatctgcaaccctattaatagcggaagataacgaaagcaactatactttattccaagccatgttgaaagattataaccttatacacgcatggaacggggaacaagcgatcgatttattcaataaatatcaaccggacttaatcctaatggacctaaaaatgccgatcgtagacggctatgaggctacacgggtaattcgggaaaagaaccagtccatccctatcatcgccgtaacggctttcgctttcgcggaggatgaggaacgggtaaaacaaagtggattctcctcttacatcgctaaaccgatcaagccggataagctaatcgcatgtattaatacttatttatagaatccgtttggtaacaatcggaaaacgcaagacgaaagaggaacccttctctacttgagagtcgagactaatacttcctccatgacggttcatgatctgccggcaaagacttaatccgataccggaacctttagatttagtcgtgaagaaaggcacgaagaccttgtcgatcgcctcgggaacaattccgctaccattatcaatcaccgaaataataaccatgccggctttttggacagcctccacgactatttgaggagataaggactcttcacaagcctctatcgcatttttcaatagattaattaatacttgttccaccatgatccgatccgcatataaatttaaatcttccggttttacacgaaagaagaggatgtcggacttctccggaaatagaagccggatatcgtcaaagagagccgaaaccgagaagtttcgtaaagtaggtaaaggcagacgggttaattgccgataattctcgacaaaatccaatagccccttacttctccggtggatcgtttgcatggcttgtaccatgatagcgtagtctctctcattcatgccatttatcgtcgcacgctcggctaccgtctctgataaagagattaccggagcgatcgagttcatgatctcatgcgtcaatacccggataagtttctgccatgcctcggtttccgcctcagcgaccaccgaattatacaatcgactccgtaaagcttccaaggcagcgttcatagaagaggccaaagccttttcgtcttccgtcattgaatcggaaggataaaacaggctcagatccccgtaatgaatactctctatcaggtattccatccgcttaacagtcttttgctgatccttatataagaaaaccgaaagcgcaagaatacaaaatccgaacagcgcaggaataaacaaaaaccctttcagcattaagaatgaggcagtaaaagacaagaccacgatccccaaaatacgagcgaacaacaagtaacgtatcataagccaaatttctccaatttacgatacaaggtaaagcgggtaatccctagaagctcggcggcacgagtgatattcccctcggcacgacgtaaggcacgttcgatcgcttctttctccaataccgtcaaatttaactcatcggatggttccttatccctaagcgggacagaacgcagaataaagtcttccggccttagccaattactttcagacaagataaccgcccgttcaatcgcatgttgcagttcacgtacattaccgggccaagcataattatgtagcttattcttcccatccctgttaatgcccttcaagtctttcttatatttacgggcatacttcgacaagaaatgttcagccaataagatcacgtcatttcctcgttccctcaagggaggaatatgtaactcgatcgtattaatacgatataaaagatcttgccggaaagtaccttctgccacaagatgatggatattcacgttcgttgcgcagatcaaccggatatcaatcggtatgggttgcgttgctcccaagcgggttatctgtcgtttttccaaagcggtcaacagtttcgcttgcatggaaaggcttaagttcccgatctcatccaagaacaaggtaccaccggaagctacctccattcgtcccggcttttccttacgggcatccgtaaaagcccctttctcatagccgaataattcactctcgaaaagttgttccggaatagagcccacatcgatcccgacgaaaagattccccgaacgcggagattgatgatataaggcgcgggcaactaaatctttaccggttccattctcccccaagattaatatattggcatccgtattctttaatttatcgaccgtagcgaaaatagcctgcatcggttcgctttcaccgatgatctcgaagccagcatcctcgggtgaactaagaatctcaacttgtttctttaaatttcgcacttccgccctactctcccgaagttccaatgccgaagagagtgtagcgagtaatttctccttttcccaaggtttcgggataaagtcggtagctcccgccttaatcgcccgcacggccttatccgtatccgaataggcagtcataaaaagaaccaccacgtccgggtctatcttctttatcttctccagccaatagaaaccctcctgaccactaatagcatcccgtttgaagttcatatccaacaagataatatccgggataaaagtccgcatgaaatgatcgatgcgctccggttgcgtagccactcttatttgttccatatagggctccagtaataagttaagggcaaaaaggatgtcctcattatcatctataattaatagttttccctttttcataagcgctgaactagtttgtgatgcctcaaaggtaggtattaaatcaatggaagaagcgtgcgtaatcgaacgattatcgtgcacagatgaactgttaaattaatagtccgcaaagagggttaagattaagtaaacggtaagactatttaagcgaaagaaaaaacgaggagaaagaaggaagactatctttgaacacaattaacaattcaggcattcatgagaccactattgattggatttttcgtctgtataaatatacacttaggctatgcgcaatggactgagcaagattcgatctggctaaaggatgtattagcaggcaaagattccatcaaattgaaccctgaattccaaaaagcaatccaaagcggttctttcctcaacccggaaccaggaaaaccgatggggaaacctcaactggccgctcccagcaatatccctatcaccaaagatttctcagaatatatccaacaagacgatacgacacaccgaaaagtagcattgaaggatttaccaccatcggtattctggcgacataatccaccgtataaaaagatactgcctgtctatcaatctatcttagatgaattgaaaaggactccgtccagtggtcgtacttcactagctaccttcgatctaggaaggatgaccagccggaaaacatatgtccataaacgcaacgcaaaacgcaacggaacttggcaaaactacggtaacctccctaccccggatgtcatctctaaaaggaagaaattcgaaagacaacaggcagaggccgcaaaaaaggactcctcattgatgatccaaccaccaatcgattagcttacgggccaagctcaacttacgggggatctccggtaagttatctttggtatagaaggcaccagaacttagttcctcatcctgcaacttaatttccccacttacataatccgctacaaagcctaccatcaagccactcggataaggccagggttggtttccgaaataagtgatattatcgacctctaaacccgtttcctcacggacctcccgacgcacacactcttccaaggtctcgccaacttctaagaatccggccactaatccatggaaagttccccggaaattacgggcatgtaccaaaagaatcgaatcctccttacggatcaagacgatcatcgctgctgagattgtcggataaatctcatgtttgcaagaaggacattgcttcatgatcgacgtagtctgtacggtaggagtaccacataccgggcagaaacggctatggctatcccaataaagcaattgaaaagccttacccgccttctcgtaacacgctctcgagatataatcccaagaggcacgcaaccccatatgtacgtaacggtcattcccctccaccggagtatctaattctgccgtacgcgcgggaagtccatcccggtaatcaacctccagcgtatgagaaaccggaactgggggattctcgccataagggatggtatacgtatcattctctttctgaagcaacagttggtctttataaaaaaggaaccaataacagagtttatttgaagtttccatgctgatatttccgaattatctttctatatgtaaaacatccgcgaacttacgaattaaaatcaaataacgtgcgaaagcgaacgtgcaccgtgcgaaggcacacacaatcgtttctaagcatttttctattatcttatgattagcagaacgttacatcgatggcacattatttgcctcttttctaaaaaatgaatatatttaaaacctgttacaatgaaactaatgattcgaaacttactttatctattcaagcggtttaagaccgccgtcgtgttaaacctcttcggcttgacaatcgctttcgccgccttcctcctgatagtaatgcaggtggattacgagatgaattacgatgccatgcacagtaaatcgggccgaaccttccggctagaggcaaatcacggagaattcgagcataacgccatccattgcctaatgtttagcgatgcttttgttaactcatccgctcatatcacggattactcctaccgttatccattctacggaggagaacggtattgccaaatcgacgaggtagacgatcaaggagaagcgaaagtatttaaggaaaacttccagctttgtctacccaatatctcagatgtctttgatttccacatgaaagaaggttccgtcgaatgcctatccattcccggttccgtactcattccggagagtgtcgccaaaaggctgttcgacaaacaatccgctatcggtaaacgtatccggatgtccggcagtagtggctggcaacctgtaagtaccacgatacttactattgggggtgtctataaggatttcccgggaaatactacagtacaaaaccgtatttacgtcccgatggaccaactggatctattaaaaagttcttggcaaatgtatgccaacgaaatatacgtcacgctagacgatcccctaaataaagaggaggtattggatcatttcaacaagactttcgatttcgctaaaagccaaatgggttcagcgcaagagatcgcattacgtctaacccccttaaaggaagtttattacacgcatgatacaactttcgactttaatccgaaaggtcaccgggagacaaattatgtgttactgggtatcgctttcctcatcttattcatcgccggaatcaattttaccaatctcacaacctcgttgattcccctacgattgaaaacgatcaatacgcaccgggtattaggatgctccatctataagttacaagccatctcactgattgaatcgatcgtgatctgcttgatatcctacattctcgccttattcatcgtaaacgatttgtcttacacaccgatcgctaattgggtagatgcggatatacgtcttagtcaatacaaaggcctgatccttctcactgcactgatcgctatcttgacgggttgcttggcgggactttatccagctatacgaagtacctcctatgcgccagccttggtactaaagggctctttcggtcttagtcccaaagggaaaaaagtacgtgtcgccctgatcggtttccaatacacggtatcgatcgccttgattattgtcaccttattcatgggacttcagaaccatttcatgacctctagcgagcaactaggattcaataaagaccaagtagccatcgtgaacctgacaccggagatctacgccaagcataagccccaatatatccagaaacttaaagattatccgggaatagaggatgtggccttctccgtctacgaattatcgaaagaagatgacatgatcgatctcgaatatgcccgtcatgaagataaggatgtattcttcaaggtattctatgcctccgagaatttcctttccgtcatggatatccaagtagaggaaggaagggattttacacgggaggatttaaacaaggcacaaagtgattatatcatcaatccggcggcagagcgggatttccacttacatcccggagatcgtttcaatgatcgtacggttctaggagtcagcaaggattttcggtttaactcttgccggatcgcaagctcgcctttcgtattcgcattgaataacgatatacccaatcctaaattggtatcctatatccgcttcaattcgaaaacgaatttacaggaagctgtcgcccacgtccgggaaacattgaaagagatcgatccgactttccctttcgagatctctttctacaacaccatcttaaacaatttatatcagaaagaacaaacactgggtaaactcatctccctattcggaataatggcgatcttgatctctatcgtaggtgtattcggactcgtgctatttgagacgcaataccgccggaaagagatcggtatccgcaagatcaacggagcgactaccggacagattcttttgatgttcaacaagacttatatccggatcgtctccgtttgcttcatcatctcgatcccaatagcatggatgggaacacaacagtggctagagaatttcgcttataaaacaccactccatctttgggtcttcatcgtagctttcctaatcattctctcggttacgatcggtaccgttactttccggaactggcaagcggcgaatgagaatcctgtgaactcggtgaagtctgaataaactcactcggagtgatcccgtaaatttctttaaagcaacgggtaaaatagttcggatcggagaagccgacctgagcagctacctccccgatcgaataagcgtgctgccccaataactcggcggcacgctttatacgtatattacgggtgaatgaggaagcggagcaaccagtagtagactttaatttccgaaataagctggcacggctcatcgccatctcggaacagaaaagctctacatcaaactccgggtcctgcaaatgggccagaacgacccttgtcactttcgaaacaaattccttatccggatcggcgatggtttgctccggagtacgcaagtcgaaccgatccctgaaatataactttagttgctcactacgtttgagcagattcttgatcttcgcttttaggacagcaagactgaacggtttaggcagataatcatccgctccggctccatacccttccaattgttgacgttcttccgctaaagcagtcaataggataaccggtatatgggccgtccgttcatccgttttcaaagcctcgcaacattcaatcccattcatgaccggcatcattacatccgagacaatcacgtccggtaggatctccatggctttctccaagccgacctttccgtttttcgctatcacgacccggtaatccgtttgaaaagcattcatcaaataacgacatagatcctcattatcctctacaaacaaaagcgtttgtcgtagattctccgggaccgggtttgttccttccaatggaactgattcccgcaaagatgcctcttccattttaggttccgaatactccaaccactcctcaggataagcctcttccgatataggcaaggcaaccgtaaaaacagaacctttccccaattcactctcacattgaatggttgccttatgtaactccaatagctcttttgtgtacgcaaggccgatccccgaactctccgagcggcgaaacgctatcgattcccccttataatattgatcaaaaatatacggtaacgattcggggggaatgccgattccactatccgtaattcgtaaagtcatgaccgcatcggatgagctttgctccaataaagcggaaaagcttaccgaaccaccatccggcgtatacttaaatgcgttcgacagtaaattatatagaacctgctctaggatattcttgtcaaaataagcgattgagatatccggggcaatcgaatacgtaaacgcaattttataggaatcggccaaaggaataaaggtttccgaaatctcctttaagaatcgactgagatccgcacaaacaatatgcggggaaggaactccccgggtcaataccgataaatccagtaattcattgacatgccgaatcaagcgattggtattccgggagatcgtacgcaaagtttctttatctccacaagattcttctgaaccggaatgccgttccagatcctccgtcaatcccttgattatcgtcagaggggtacgaagctcatgagagacattcataaagaaacgagttttcaacacatctttttcctccagttcttgcttggcctgtttcaacagccgtgtacgttcttgtatcttacgctccaactcggcttggcgaagctgataccagcgcacccggctcttataggcgatatacaacagtacgcatacaaccacgaataccagcaaaataaaccaccacgtccgccaccaaggaggaaagatcctgacaggttcggtaatgggagcgctccaataggaaccattgccggaagtttccacccgaaacacatagtttcccggtggtaggcggttatatatagccgtacgatcgctggcgtccacctcccgccaatccgtatcatatccatccagacgataccggtatcggatactacggggatgagaataatcgaacgcgataaaacccacctgtaaaccttgcttctcacgtgagtctccgatcgtgaggttcgtgattcgcaaagactcaggtatttttctcaaaccgtccgttaactgaacgggatcaaaagaaacgatcccctcattactgccaaatacaagttcacccgatttgcgcttacagcaagcgccacccataaactcattcgataataaaccgttcgccgtcgtataattaacgatatgccggttttgtatatccaagcgactcagccctttattcgtgctgacaaacaggatgcccggctcaccttcacggattcctcgtacgatatttcccgataagccatcctgtaccgtgaaatgatcaaatcgcccggttcgcttgtcgtattgatccaaccccgcattcgtaccgatccacaaataaccggaagagtctacaaacagacaatgaatatgattcgacgcaaggggattcatctcacccggtatatatcgatacgtgataagcgctcttgtcttcgtatcccacacccgaagccgcccctcatccgctcctccccaaaaccaagactcttcgctcacgcataagttacataactccgacaacgagttgatcggataatcataagagacttggtaatccggtataaaagggcggattcggaaatcatccagattcaaccggtccgggttggcgtcttgataactgatccataggttccgctccgaatcctcacggatagaacctataatctttccggataaagaggacggactttttcggggtgagaaggtaaaacgcatatctacccgggaagtcttatggttaatccgatctaatcccctagaggtcgcaacccaaagattcaggtccgaatcctcataaacggctaggatatgaagagaagacagattctctttttccgtgtatcccaaggtatatcgaaacaaggaaggtgctaaatccgcatggctcaccccatacgtggaatgcccggcccacagatgatccgagtcatccagaaacaaacaggtaatctggttactgctgatagaatgtgcgtcttccggcacgttcctcaactgtcccattttcctctccttcggagaataataaaaaagaccttgattgaaacggctatcatcaaaccagaccgttccgtcgttactctcgaagatggatcgcacttggcattctcctgtaggttccagatcctccggccggtcaaagaaatgctcacatcgcaaggcaagccggttcatccggctaatcaagcttgcccccttattatgtccgatccagaaatcaccatcaccggtctccaagaattgatatacccgagtatcctcacgaccgacagattggaagatctctcgctctcccatatcaaccgaacgaaaagccccttcacgtcccgtacctaaccacatataatcaaaccggtcgatatagatcgcattaacgccattcaaattgccggcattgatatcctctcggtcatttgtccgtatcgtataatcttgaaagtggtttgtttctttgtcatacaaactaaaaccagctaaagtccctacccaaaacgaatgatccggcgccgaatacaaacaattcacaggagacgacgagactaccgaacccgccggcgaaaggcgtaccaatttcttctctttagcgtcatactccaacatcccgttctccgtacctataaagatatgtcccggaacggaggccgagaaacaagtaggactaccatacacacgtaactgttgtcgaagccattctttcgtgaaattcaaaaatgtatccgaacctctgtcataacggctaatcccacccgaggaaaaaaagatccagatacctccatctgaatcctcgaataatttatcgatagaactgctttgtatactttccggacaatccggtacgggcaagaatactttaaacgtatatccatcgtagcggttcaagccttcagtcgtcccgacccagacatacccggtacgatccttcaaaatagaggtcaccgaggaagaagaaagcccgctatccattgttatccggtcaaaaataacgttggtagcttgcgttctcgttaccataagtacaaacagcagtaaaaggtatattctcatccattcatccgattaatgccccaaatataaagattaagtgggtgaaaatcacagaaaacagaaagattgaacgatttgtacggtattatgaaacatatgtccggcccgctccctccctatttccctagctttgcggtatcaattctaaaacgaatgtaaaatatgagaaaactttttctatcgctagtattccttagcgcactactatctatccatgcgaatccgggtattaaaggaatcgtaatcgatcaaaccacccgtaaggcattagactacgctcacgttgtattatatgatggagatcatatcgtcgaagaagctatgactgaagcgaacggttcttttctaatccagcccgtaaaaccgggaacgtattcgatccgtatccattttctgggatatgatgtttatatgggagaggagtttatccttacagagcaaatcaaagatctgggtattatcccgatgcaaatgcttgaggtaggcttacaggaagtggaggtcgtagccaacaagaaacaagtcatctataaactggataaaaagatcatcgaggcttcttccaacctgctttcctcgggaggaaccgctgtcgatatcctagagaacacgccttccatccgggtgaacgccgagggagaggttaccttccggggaagtagcggattcacggtctacgtagatggaaagcccagtatatttaccgggacccaagccttggaacagatcccgtccggacaaatccagaatatagagatcatcaccaccccgtccgcccaacatgatactgggggtgatgtcgggatcatcaatgtcattaccaagaagaacttcggggaagggctgagcggagtaatcaacctaagcgggaatacggtatggagccggaccttggatttcttgttgaccggacaaaacaaggcgtctcaatggcgtataggcggttatgtgggaaaccgacttcgtaaaagtcattttacccaagagaaaacgacgttggtaaacgatacgacaacgacttcttattccaatggcccccgtgaaagtaacggctacgcatatattctcaacggaggttggagctatacgcaaaaacaaacgactttttctattaacgcggaaggcggatatgccggactcaagcgaaaaggagatctggaatatacggaagaacgttccgctaatggcgagcaattcgagaacggagagttcaagagccttgacgactttgatatccatgagactttcggactagggaatctggccgtggatcataagttcaatgataaggggcataaccttagcggtagcttcttcttgaaatatggaggcgacgctctggaatatttccaaagcgatctgttcgacaaaaacaacgtacgccagcaaggtcatcgtgcgtgggaggccgaacatcgttggaccgtccgtgcgaaagccgattatgtatttccatacagcaaaaccggacaaatcaaggcgggttatcaatatttctcatactcggaagacggcgattatagtatgcagttttggaacccggataccaaagagttcttctggcgtgacgatatttacaacacgttctatttccaacaagggatcaactccctttatgcgatcgttggggatagctaccggtcttttgattttcaagtaggattacggggagaacatacgcatcaagtattacgtagctccaaagattgggcgaaccgcctacaaaggcgttttgagttgttcccatccgcccatatcggttataacctcacacaaaatcagaagcttctattcgcttacagccgtcgtacgacccgaccagagctttatttcatggagccatacatcacttacaaggattactatacagccgagatcggtaacccggatatacgcccagagtacattcattctttcgagttgaattattccttgacttccggcgacaatgccttgtctgcctccctattccaccgaacccgcaaagacaagatcgaacgattacgggttccttaccaagccggggttaccttggattccatggcgaacgtgggacatgattattccaccggaatagaactatcgggcagtttgcaggccaccagttggtggaatacgcaaataaacggtagcctttatcactaccgggtagagaacgagtataagacggacgggaagaatgagaccagtaccaattacgagatcgcatggaacaacgctttcacgaccgggaaatacacaaggatacagcttgacggcaatttcgtaggcccttccgtaaccacccaaggaagaacccagtcgttctggtttgtcaacctagcgatacggcaacaattcttcaaacggaagttgacggccaccctctctttccgggatgtcttcaatacggcccgttatgtcaatacgatcacttcctcgaacttgatttccaaaacacgaatccggcccgattacccgttgataggcttgacccttagctatacgttcaaccagttcaagctaaagaatggcttatccaacaattcaaaggatttattcgaggggacgaatcattaataccgaattaccctactttcaaagtaagctagcttcgttggcaaagtaagctaattaaaatgcccaagtaagttaacttactttgccaacgagataaacgtagtggtccttatatcttgtttaccgaggatagaatacatcattgggtaactgtaacttttttgaatccaactttgttactttccaattttaagttacttttgtgaacacttagttaaaaatgaggtatattcaatgattaacagcatattactgactaatttcacgggctttgcaaacaatcgtttcgatttcaccgaaggagtaaatgtcctcatcggcaagaatggtaccggcaagacacacgtgcttaaatgcttggctgccaccttgcaggcacgtcacgacttcctcggcaagaactctgcttccaaagagcagtttgagtatatcttggcggaagatatgatctattatttcaagccggacatcatcggcaatttggtcagcaaaggactaccttccggtagggcgaacattgcggttacgatagatagcaaggtattgcaatatagcttttcctctgcagccaagacgactgtgaaattggaaacggacgagaagtggaacgaccgtcatttcatctacatccctcctcgtgaaatgttctctttgttcgagggttttatcggtttgagcagtaagcgtgagatttcattcgaccagacctacatcaatctagcacacgcattggctctccccgtattgcgtgagtctgaagataatccgttgagaccggctgttgagttgttggaacgggaattgcagttcaaggtgctgcagatgaacggacgtttctatatacagacggaaagtggtaatatggaagcgcatttggtggcagaaggtcttcgcaagttggcctctatcttatacctcatactgaatggggaaattaatgcgaacaccattctgttctgggatgagccggaagccaatttgaacccggctcttatcaaagtggtgtcgaagttcatccttgtgcttcaggaatgtggtttgcagattttcatcgctacacacgattatttgcttacacatacgctttctctttattccgagtataaagaacacaccggtgtatctgtcaaattctttgggctgaaaaaagaaggcaagggaatcattgtagaggaaagcgaaaccttggcaggcatacagagcaatccgattctggaggaatatgcagccttttacgacttggaacaacaattcatcagcaaatatgagtaattttcaggaaagcggcataaacttcaagtttcaatctcccaaatggaacgttgtcaagtacgacgaacatttggcgcacaaaaaagtaagcaatgccttgcagcctaccaaagcggtggactttttaggtattcatgacaacagacagttgtttttggtagaagtaaagaattacagagggcatacacacgatgcagagactcaagaagtgcttcaggcaaaaggcgaggaattaatgcgcaggattgctgtcaaagttagggacacaatcgccacggtaaccaattctgctcgtttttcgaccaatgatgaggatttttttacccggattaatcagttgctacttgataatcagaaaaagatagtcattattgcctgtatagaactggacattgctggtgaaaaagaacacaaagcccgtatgagtgtctggatgcaaaaattaaagcaaaagttggcatggttacatgcggctaaaatttccatcaatccgattgaaaatatctctgctgtcttgccggatacggaaatcttgttcgtgtaatctcccggcaaactttagtgacctttgttgccggtcttttattagtccgtctttttctcttctgtggattccccaaaagtaagccccgatcgaataaacgaccggggctaattcttttcccgctttccttcctcacggaagtactaagggatgaactttaatttattactttagtattaatattaatccattcccgcttgttccacaaacctaaaaataatgattttttcagggttctgtaattagttctaccggaaccattgacattccccgatatgaaatatcagagatggataaacaagaggctgtggaagataatgatccttattcgatacttagtatttttgaaatagaacgaatcacggaaaatacgatagaggaattaccagatcaatgtaaatccatttttaaattgagtcgtataaatggactcaagaaccaagagatcgcagataaattggctatctccgtccgtacagtggaaacacagatatatagagcccttaagattttgaaaagtagattgaaagactatctggtttcttgaaaaaatataatacaaaaatctatcaatcttgtaagtagcacatcgttttgaagtgtcatacatatagaatcgagaaaaaacaatgaaagaatatataaaaaatataattgcggaaagtctcaaagacgaagtagatgttgatagggagtgggagcgtttgttttcatccatagagaaaaaaactatttccaaaatgaaaacaagaaggctattccttcaatacatgaaatatgccgctgctgtgcttttgggtataggtatttcactatcaacgttgtatcttacgaatcaagagaacttatcgacagttggaaattataaattagtaacgagcaaaggtgagaagagctatttgcaattaccggatggtacgagggtttggcttaactcttgtacaactttagaatatgcggagaactatggccattccaatcgtagcatttatttggatggagaagcttattttgaagtcgcaaagaataaagacttaccatttgttgtaaaggcaaacggtatcgatgtgaaagcgattggtacggcctttaatgtttccgcttatatggaagactcgcaactaaccacaactttgttcaatggaaaggtcgccgtacaacctacgttgactaaacaagaggtcttacttgagcctaaccaagtggcggtttatgataaaagtagaaataagatagaagtagtaccttacgataagaaactattcgctcaatggagaggaggtttcttgtcttttgaaatgatgtatctgcaagatataacaaagttgttggaaaggaactataacgttgtatttcgttatgaaaatcaagggataaaaaaattaaggtttagcggaagtttccgtaacaacgaagatttatcggagattctcaatgtgataaagacgaatacgggcattcgctatcaaatactgaaagatactatagtaatcaaataataaatcattgaattattaatcttaaaaacagtcttgcttatgagaaatggatgatttttagtgtaatacggataaaaacgtaacattgttagatcttattattaatcttaaatttattaattatggctaatcagatagggagttccggtagaacgttccggtagaactaattacagaaccctgaaaaaatcattatttttaggtttgtgcttaacctttttccagccgtacacagtagcggcatcagcacaaattatatccttaaatatcacaaaaggaactatcactgaagtttttaaggcgattgaagaccaaagtgaatataaattcttttataatgacaatcaaatcaatttgaataaacgggttgatgtcaatatccatgaagaatccatagaacaagtattaaacaatgtctttagaggtacggatattacgtataagatcgtcaagaatcacgtagtacttaccaacaagaccatgaaagatacggagttgccatccaccaaccaaaatcgcaaacggctaaccggacaagtagtaggacaagatggggagcctctgatcggagtaaacgttgtagtgaaaggtacgacaatcggatctatgaccgatatggacggaaactacattctagagaatgttccctccaacgctaccgttgaattctcgtacatcggctatctccaacaaagtatcaacataggcaataaaagtaacctcaacgtcactttagcggaagacactcaaaagttggatgaggtagtagttgttggttacggttccttcaagaaaagagatttaaccggagctgtttctcaagtaaaaggagatgagatctcgaacctaccgcttcgcagcgctgccgacgccttgcaaggaaaagcagccggtgtaaccataacatctagttccggtagcccaggttcactcggtaatgtccgtatccgtggtgtcggtactatcaataataatgatccgttgtatgtagtagatggtctacctcaaggtgatatcggttggttaaatgcccgtgatatcgagagcatagaggtattgaaagacgcttccgcacaagcgatctatggtgcccgtgctgccaacggtgtgatcctagtgtccacaaagcgaggagcttccggcgagagttaccgaagcaacatcgagtttgatatgaacattggtttccaagatgtagtgaaaacgtatgacatgctagacgccgaaggtttcatggaatataagaaccgggcttacgccgcatccgggaaagccttgatcgatgatttcgccacatcagagaagcgagagcagatccttactttcctagggaaaaacggaggacgatccggtacggattggtggaaagagagtacccgtaaacccaaggaagctatcagtcagaattacaacctagctttctctggaggtatgaagaaactcagataccgtgctagctttggctatatggatcaacaaggaatcttgaaaggttccgactatgaacgcctctccggtcgattgaacgtagactctgaggtaaccaagtggttgaacctctccgcaaatgtgaacgtcacgtacgaatccaggcgcaacctagatgagaataactcttacacagcaaccgtgttcagtacccttgcggcagacccaatcactccggtatatcgcgacaacctagtggatatcccagatttcttgcaaaaccggattatgggtggttatgagccgaccaatccttggtctcgctatacaggcgtgatttactcaaacaaaccgaacacggttggacaggtagaccgctccgcattaaatcaatggcacgggatcgccacgaaaagtaatatctccggcgaagtcaagttgttacccttcttaaccttcaaatccagtatcgctcttgacttagtccgtaaccaaagcgactctttccgtccttcttactatctggatggagatgagtactccacttatgcgggcgccagtcggagcgtagcgaataaagattactgggtattcgacaattacctaacttacaatcaaaaattcgacaaacatgcggtaacagccatggtcggtacctccgcggagaaagaacgctacgaagagatctacgcctataaagaaggacaggtcaacaacaacccgaaccagcagatcatcaacgccggtaccatgaatcccgccgcatcaggctactacgccacaagtacgctgaattcttatttcggtcgtgtattttattcctttgacaaccgttatatgatcacagccaatatccgttgggatggatcctctaaatttgcggatggtaatcgctggggttgcttcccctccgtatccgccggttggaatttctcggaagagagcttcatgaataaccttgagtggctgtcacaaggtaagttaagagcagcttggggtgagatcggtaaccagactatctcctccggagcctatatgaatacattcggaaatggtagctactacctcttcggtaatccgtatcagacgaacttgtatgccggacgtacgcaggtgggtaatccggatctgaaatgggagactactcgccaactggacttcggattggatttggcctttttccaaggttccttgagagcaaccttcgactactttgaccgtcagacaagtgatatgttggtgcaagtacccgtgcccagttcactaggattccccaacacgccgtggatgaatgccggtagcgtaagcaataaaggttttgaagtaacgctaggatacgacggtaagatcgggaacgacttccaatatcatatcaacggaaacgtatccatctataaaaataaggtaaaaagcctaggcagtggagcgaatattccgggtaaaggcatccatctaggatacttctcctatacgatgacagagccaggacaaccgatcggttatttctacggatataaaaccgatggtgtcttccagacccaagaagagatcgacaactacaagaacaacggtcaaatggtaatgccaaacgcaaagccgggcgacttaaagttccaagatttgaacaaagatggtaaactagacgacgaagaccgcacgatgacaggaaatcctcatccagacttcacctttggtttgaccttaggcgcagaatggaaaggattcgacatctccgccttcttccaaggatcagtcggcaacgacatcttaaacatattgaaatatgacatctattcaggtaccggttggtacaatgctccgaaagatatattaacaacctactggaacggaccaggtagtacaaacgagaacttcgcaatcgatgcggatagccgcatgaacttggaaatgtccgattggtatgtggaaaacggttcttatgttcgtttgaagaacctgacaatcggttatacgcttccgtccgaatggactaagaagatcacgatcaacaaccttcgtttctttgttgccgcacagaacttattcacgatcaccggttattccggactagatcctgagatcggagagatcaataactcgcctctttacaaaggctgtgatatgggattctatccgcaaccgcgtacattcatgttcggtcttagtttgaaattataatcttaaaatgaattattatgaaatctatagttaacatagggaaattacttgtatcgatcgcatgcgtcggtgcccttacgacaagctgtaacagcgactttctagaccgcccgccattgggaacattggatgaggtaacttatctgagtaccaaggatgccggctacaaacttttggtcaattgctatcagcccttacaggatagctggaactatcaggacatgaaatttgtcttgggagatcaattgagcgacgactgctccaaaggcggctctgatgcaggagaccgcgttcgtatcacggaaatcgcccgcggaacaccaatggcgactaatcaagtcttgtccgacctttggactcatcgctaccaaacagcgatctcagcctgcaacgtattcctatcgctaatcacacctgaatcagaattgatcgatgatgccggaggcttggtcagcacagaaaccaaacagcgatggatcgcagaggctcaattcatgcgtgcgttctattactacgacctagctacaatcttccagaatattccactacttgacaagcccttggaagtcgtcgacaaaagtacgatcacgaaatccagcaaagaggaggtcatgaactttatcctgaaagacctgaacaccgcaatcgccgaacctaatctacctaatgcaaaaagccttccgaccagcgagattgggcgaatcaccaaagaggccgccatggctttccgtgctagggtattgatgttctacggcaactacggagaggctctgaaagacctgaaggcagttgtcgaatccggaagctatgaattagtagatgactacgagaagctattcaatagcgctacagagggctatatgtcaaaagagtccgtcttcatcaccctgcgctcttacattcctagctacactggcggtagcgtttgtccacaaatgaatgtcggtcgcggtattgccggcggatggggcggcgagtgtccgacgaaggatttggtagacgaatatgaggtaggcgatccacgcttggtacacacggtattgtcatccggcgatatattcgtcaagaacgatggttccgaagaggtacacgactattccggctacgacaatttcccacagcaacacagccgcaagcagtatccagacttctccagacggccactaaacgatttattgaacacagattggacccactatcacatccgctatgccgatgtattgctgatgtacgctgagtgcctgatcgagacgggtggcgacaaacaactggcggccgacctgatcaaccaagtacgttaccgtgccttcgtgacaacctccttgacagatagctacgctaaataccgtaagttcaatctcaaggagagcgatcgagtgaccgaggatactttcaacgctaagtataaagtgaaagcttccgatgatctgcgtgccgcagttcgccacgaacgccgtatcgaacttgcaggcgagggattacgcttctacgacttaattcgctggggcaccttcgtatctacaatgcagaaattcggcaagactgatgagggcaagtattccggtgccgggacactcgtcaccgataagacatacccctacccgattccacaaagcgagatcgactatgtaggaggcgcattaacacagaacgataattattaatcttcaatttttattactgtagcccccgcagatagtccttcttgttgtctgcgggggtttctattcacgaaataccttagaaatccatgaaacgaatcttatttctcctaaccatcgccctcctaaatttgggaagtggcctatgcaagacacgacaatcgttaagaatcatgagctacaacatccgcatcgggatcggtatggaccaacagaccaatttgaagcgaatcgctgaagtgatcaacaagatccagccggactatgtcgggctacaagaggtggacagtgtatgcgaacgctctggatggatcaaccaatatgcagaattggcacggttgaccggcatgtatccaatcttcgcacccgccacagaacgttctaagggattatacggaatcgccgcactctcccgcaagaaacctcgcagctaccaatacatacccctgccgggaaaggaagagccacgtacctttctttgtctcgaatatccgaactataccttgtgtaacacacatttctcgctcgacccagactctcgcctggcctctatacgactcatcaatgagacgatgaaaagagaaaacaaaccaatcctgatcaccggagacttcaacatggagccagactctaaagaattcaaggcgatgaaacaaacgtggaggctcttatccgaccctacgttagagacctacccctcggatcatccccgcttgcgtttagattatatcttcggcgacctaaagcatgaatttaggattatcaacgaccaagtgatcgatatccagtcgtccgatcacctgccgatctatatagacgtgctattttaagctttctccccggacatcctcagaatcccgaacaatacgaatctagaaattcttaacgttgtccgggattttcatgcaataagaatgcttccaattggttttaagcaaaatatttcctagttttgcgcaataatattacagaattaaaataaactgggatatgaagaatataatcattatagctagtttactcctcggaatgccgcttatggcacaaaccaaggtggtaaaaaagaacgccgtaaaagcaaataatttcggaatcacctactcgttgcccaagacctcgctagtcgtagacgccgaagtgacgaaagtaacttgcaaagccgggccttactaccaatatgcagagaagtatctaggcgtaaaggatgcagtcacggaagacaaggtttatttcgacctcggaaaaatcagtctgatcaaccggggattacccgatgcggataatacctatatcgtagaattcaagcaaggtacggtcgccccttacgcttatcttaccgaagatggattattatgctcgataaacgcagaatacacgcctgttgaatccgagctagatgctgtaaagaaaaataaaggtcctcagcaaaaagtgacagacacttccgttttctcggaggaattactaatggcaggctccaccgccaaacaagcggaggtggccgctaaacaaatttaccgtatccgggaaagccgtttgaacatcttgaccggcgaggcggataatttaccccccgatggtgaagccatgaaactggtgatccagcaattggaggagcaagaaaaagcattaacaaacctattcaccggaatcttgaccaaagaaaccgagcattatgaggtaagcattatccctcacgacaacctagacaaagaagtattgttccgtttctccaagcagctaggtatcgtagacgctgacgatttgggcggtacccctgtctatatgaacttgaaagcgacagaaagagctccgatccttgatgccaaggaagccgagaagaaagacaaatcattgaaaggaatcgtctacaatgttccgggaaaagccagcatagaaatactaatgaacaaaaaaacactctacaaaggagaggcccaaatcactcaattcggaacacgggaaggattagcccctgttatgtttgaggataagaaagcccctgtcaaggttcttttctatccggaaaccggcgccataaagcaaattattcaataagtataaactaatattatctaaaacacatgttacaaggacaacctaaaggtctctatgccctagcactcgcaaacacgggcgaacgcttcggttattacacgatgcttgcgattttcacattattcttgcaagcgaaattcggctatacggccgctgagacatcaacgattttcgctagcttcttagcgttcgtgtattttatgccattgattggcggtatgatggccgataagttcggttatggaaagatggttacctcgggtatcatcatcatgtttgtcggttatcttttattagccatcccaacagatgccgcctcgggaaaaatcatgatgttcggctcgctagcgctaatcgcttgcggtaccggattatttaaaggtaacttacaagtgatggtaggtaatctttatgatgccccggaatatagaagtaaacgtgaccaagcctttagtttgttttatatggcgatcaatatcggtgccatgtacgcacctacggctgccactaaaatgacagactggatgttgggtaagtataaccttttctacgagtcacaaattccggcactcgctcaccaattcttaaacggaacaatctccgcagagaacaaagaggcactcgccgctctgcaaagcgcacaaggtttcactggcgatatggctacgttctgttccacgtatatcgagaagttgtccgaggcatacaactatggattcggcgtagcttgtatctcattgatcatatcgatggctatctatatgggattccgctctacctttaagcatgcggatgtcaataccaaacaagcacaggcttcccacgctccgcaagaggaattgtcacctgccgagacgaaacaacgtatcaccgccttgctgctggtattcgccgtggtattgttcttctggatggctttccatcaaaatggtctgacaatgacgttctttgctcgcgactatacggccaaccaagtgaccggactggatcgtatcggctttgatgtgattaacttaacattattggttatcgccgtgtatggaggattcgctatcgcacaatccacaacgagcaaaggcaaaacgatcgccggcatcgtgaccgtggccgcattagccgctctaggtatcaaatatatggctatgccggaaaccgtaacgatccttccgcagaccttccagcaatttaacccgttcttcgtggttgtattgactccggtatcgttggcgatctttggttatctggctaataagaagaaagagccgtccgctcctcgtaagatcggattgggtatgatgatcgccgcttgcggtttcttgatcttggcgatcggttctatgggcttgcctacaccggacgctttagcggcggatagcaaattgcaggtattggtttctccgaactggttgatatcgacttatctggtattgaccttcgccgaattattgctttctccgatgggtatctctttcgtatccaaagtggctcctcctaaatacaaaggtatgatgatgggtgggtggttcgtggctacggctatcggtaactatctggtcgctatcatcggttatttgtggggaggcatgcagttatggatggtatggagcgtgttgatcgttctttgtttactgtctgcgttgttcatgttctctatcatgaagaaactggataaagtggcttgacaattgaaaattagaggatgaggaagtcgtatacatatcgttcgcaggcactccgtttcagaagatggagccggaaggcgtatgcggctttcatcagtatacagagggctgttacgatcggacaattatccttttccgtagccgatcgcttcgaaaaaaagaaccagtctttacataccggtatcggtacgttcacggacggatttttcgaagaggataacgaggagagggagaataccgaggagaacaaacggagcctcgcggtatcgcatggactgtttacggcattactcccggtattggtatcaaatgagatcgctcatccggctcatcgtgtagctcactatacattatataatatagtaaaggcgggaagtattctttcggatactttccgcctttcttatttccatccggttgtagagacgggacgtgccccgtctctacaactgggtatatatatacacggaattattaaatgagagaaaatgacaatagaagaagcaaagcagcacatcctagagggtgggaagattactgaggaacaggctttaagcttggcgaatcacccggacaaagaggcgctttacaaggccgcccaccaaatcacccgccattttatggggaataagttcgacacttgttccatcatcaacgccaaaagcggtaattgcagcgaggattgtaaatggtgcgcacagtcgggacattacaagaccctcgtaaacttatatcctttgcttccggccaaggaatgtgtctatcatgcggtatataaccggaaacagggcatccggcgttttgccttggtgactagcggcaagcgagtatcggataaagaattggaacagatcaccgatacgatccggcaaatcaagcggcaaagcgatattaaatgctgtgcctccatgggattgctaacccgctcccaactccaatcgctttacgatagcggagtggagaattatcactgcaatatcgagaccgccccttcctatttccgtcaactctgttccacgcatacgatcgagcagaaaatggaaaccatccataccgcccgggaaatcggtttccgtatctgctgcggcggcattatcggcatgggcgagacgatggaggaacgaatcgagatggcttgtttcttacagaaagaaggtgtcttatccatccctctcaatttattacagccgataccgggaactcctatggagaatacacatatcctagaagaagaggaatggctaacaacgatcgcccttttccgcttgatcaatccgaacgcatttctccgtttctccggcggacgggcacaattaagcgaggccacgcaacggaaatccctatatatcgggattaactccgcaatcatcggagacttattaacgactatcggaagcaaggtagaggaagacaaagtcttatttacctccgaaggctattcactcaccgaaaacaccgattgggaaaaatgacaacaaccgaacttttacaatacgaccgggatcatctatggcatccctacacctcgaccatcgatccacttcccgtctatccggtatccaaagcggagggcgtaacgataacccttgcggacggcagggagctaatagacggaatgtcttcttggtgggcggcagtccacggatacaaccatccggtacttaacgcggcggctaaagcccaattggataagatgagtcatatcatgttcgggggattcacgcacgagccggctgtcgagttggccgctaaattattaccgctattgcccccttccctagaaaagatattcctagcggatagcggctcggtagccgtggaggtagccttaaagatggcgatccaatactggcagtccaaaggcataccgggaaaacataccttcgccacgatccgtagcggttatcacggggatacttggcacgccatgtcggtatgcgatccggtgacgggtatgcatgggatcttctccggaagcctacccatccaatacttcatacctcaaccttcggtccgattcggcgaggaatggagagaggaggccatggctcccttgcgggatttactagagcggcatgccgacgagatcgccgccttgatcttggaaccggtcgtacagggggcaggaggtatgtatttctactcccccactttcctcgttcgtgcccgggaactttgcgagcggtataacgtcttattgatattcgacgagatagcgacaggcttcggacgtaccggaaagttgttcgcatgggaacatgcgggagtcgaacccgatatcatgtgtatcggaaaggcattgacgggaggttatcttacgctttccgccacgatcacgacgaagccgatagccgacacgatctgttccggcgaggcgggatgctttatgcatgggcctacgtttatgggaaatcccttggcatgcgctatcgcttcggcctcgatctctttattgatcgccagtcactggcaggagaaagtgaagcttatagaggagcaattgcgggcggagttagcgccagccgccaagctgcctgaagtcgctgaggtacgggtattgggagcgatcggggttatcgagatgaagcatccggtggatatggcggtattacaacgccaattcgtagaggaagggatatgggtacgtccgttcggacggctggtttacctcatgcctcctttcattatctccatgaatgaactatccagactaacctccggattattgagagtattaacgcataattaacatatctacaaccgggtaatatatagatatatgaaatcatataacgagcaacttacggctttacgagcctccgggaatcttaggcacctaccggaagtcgagcatcaaggaatatggatattaaaagagggaaagcgtatgctgaatctctcttccaacgattatcttggattagccagccggcaggatttacaagaggagtttcaagcatccacacaagaccgcttctatccctactcctcatcatcatcccgcttgctgacgggtaatttctccgtatatacgaaactggagaaacagatcgcccgttccttcgaccgggaagccgcattgatcttcaatagcggctatcatgccaacaccggaatcctcccggccttaaccgataaacagaccttattactcgccgacaagctggtgcacgccagcatcatcgatggcatcttgttgagtggctccccattcctccgttaccgccacaacgactatgaccaactggaacgcctcgtacaaaagaacgcctgtcaatacgagacgatcatcatcttgaccgaaagcattttcagcatggacggggatgtagcggatttaaaccgcctgatagctatcaaaaggcaatatcccaatatcctattgtacgtagacgaggctcatgccatcggagcccgtggaaagacggggctaggtatcgccgaggaacaaagttgtatccaagagatcgatctattggtcggtactttcggcaaggcgttagcgtctatgggggcctatttggtttgttcccgtacgatacgggaatatctggtcaatacgatgcgaccgctcatattcagtacggccctgccaccgttccaaatcgcatggacttccttcatctgggagcaactcccctcgttcacgaaggaacgggagaatcttctagcatatagccgattgctggcggaggctttaacgggcaaaggaggcgagatcagccaaagccacatcatccctttcattgtgggagagagcgaggattgcgtacggaaagcggaagagctacaacgaaaaggcttctactgtctcccggttcgcccgccgacagtgcccaaaggtacctcccgtatccgcttctcccttacggcaaacctcacaataaaaaatattcatcaactgattatagagacggggcgtgccttgtctcccaccgggacatgccccgtctctacacccccggatagataactggatagatagtatgtatataaattgaattgatagtatgtatatagataagataataaataagctatcccctagtctgatcctctgtctcgccggctggtccacctcgccggagcttttccgccatctggaagtaccggagcagacagacctatggattgcctacgattacaggacgctcgcattcgaagaggcattcgccccctataaagaggtacatctggtcgcttggtctctaggcgtatgggtagccacccgactctgggcaggccaccgatcctttaccacggcgaccgccctgaacggtaccccttttcccatgcacgatacgctaggcatcccgaccgcgatcttcgagggaaccctccatcatatcagcgaggaaggtatgcgtcgctttaaccgcaggatgtgcggagacaaggagacattcaattgctattcggaactctcaccacgtccgctggaggagatcaaggaggaactggaatctctatataatcagatcctcccggaaaagctcgaatcagccgatccgcggatatccgccttctgggatcaagccatcctgtccaccgaagataagatattcccggcaaccaacctccggaactactggcaaggccgttgccccatccaagagatcaaggcgcctcatcttcctttttaccactatcaatcatggaacgaattatggaagtaatcgaacaagaacggatccgccggcgtttcagccaagcggtgaatacatacgacgatcacgcggaagcccaaaaacggatatgcgcccatctggtacagctattgaccgtatacacctcctctcatttccgcagggtgctggaaatcggttgcggaagcggcggattcacccgtttattaaaacaagaatgccaaatcgaggaatgggtactcaacgatctttgcgagacttggcaaagcgccatcgaggagttgtttccttccgtccctcctctattcttggccggtgatgccgagcgactggcttttcccggcacgttcgacttgattgcctcggcctccgccctgcaatggatgaaaaaccttccgcgtttcctccataagctatcgtccaccctatcgcccggaggcatactggctttcaacactttcacgccggacaaccttcacgagatcaaggaactgaccggagaagggctcacctatcctaccgccggacaattaagggagtggttatccacctacttccggatcgtccatgaagaggaaggaaatattgccctgaccttccggcatccgctggaggtgctaagacatctaaagtacacgggtgtcacggccaacgcctctagcgtctggacacggggaaaacaggagcgtttctgccgggattatcaagagagattcccctcggcggatggtggggtcacattaacttaccgtccactctatatcttagtggtcaaaagataaaggtgaagtaggtcgcctcttccgaggtattgatcctttcacctatatgatatgatcgtatcacaagggtgaaacgatcttttcacctaggtgatacgttcttttcacaagggtgaaaagatcaatagcacagaaaaaaaggaataaatctcttagggacaagggggaatatccatagagacaaaagattaatcaagcaactatttaaacaacagaacaatgagccatcaaacgaaagaaaatgtattatttatctccggcatagacacgaacgtcggaaagaccgtagccaccggaatgatcgccaaggcattggcgaaagccggaaagaaagtgatcacccaaaagatgatacagaccggatgcgagcacgtatcagaggatatagaggcacaccgccaaatccaagggataccctttaccgacgaggatacgcaaggactgacttgtccttatatcttcacctatccttgctctccccatatggcggcggcgaaagatggaagacgtatcgatttagacacgatcacccaatccacccggcgattgcgagagacctacgagtatgtattactggaaggagccggaggactgatggtgccgaacgacatggaatcccttacgatcgattatgtgaaggaacaggcgtatcccctgatactagtcacgtccggcaagctgggaagtatcaatcatactttgctcagcctgtacgcctgcgaacgatacggcatcgaggtaaaagccatcgtctataaccaatatccaagcatcgacccgctgatcgaggcgaataccttggagtatctaaaggtcaaattcccggaaatccccttaatcctccttccggaaatgaaaaagggaaacgaggagcttcccgatattcgcccgttgctataacgccctatcaagcaggatcaggaaatagatccagtattttctgatccgcttttctccggatctccggtgtaatgctatccttcaccattttcaatacgaaagtcatcaccgctacatcgtccgtgaagccgataatggggagcacactctccgggatcaagtcgaaaggcagtataaagtaccctaaagccccgattatataagccttatgttgaagaggcaccttttcatcctgcaacatataatacagcgtgaagacaggacgcaataccgtagcccccactttcttcgctacccgctctatcttcttccagaaactcttctccgagaaataagtcccatatctttgtatctcatgtacttcctcgaaaggaacatcctcaatctttcttgtgtccataaacgaatcctattaaatcatctttcacaaagataacaagtagtgtagaaaaattgcacatcaaatgaggaaatattacacaatgccacctccacacccgtattcaaagcttttcgtaataatctcataagaaaacaattataaagaaacctacaggatttatcacatctggcacgcctttttcagataatcctttagttagtataggtattaataagacgttttaaacaaaaagagatgagaaatgtaaaaacatggggcatactattcctatgtctacttctattgcccggggtagcgtatgcccaaaaaagacagatcgaaggaacggtgatttcccaagaggacaaggagcctctgatcggagcgaccgttatcgtaaaagggagcctgtcgggagcggagaccgatctcgacgggcatttcacgctggaagttgatcctgacgccaaattcattattgtcgattacatcggcatgaagcagacccaagtacctatcccgaaaaacggtatcttaaacgtggctttacaaccggaggcgatgaacctcgatgaggtcgtggtaaccggttacggtaacttctcacgttcttcctttaccggttccgccaacactttacgggctgacctgctgaaagagatgccggtggtttccatagaacagaaactacaaggcatgacctccggtgtcaatatcacgggaagctccgggcaaccgggagcgaacgcatccatccgcatccgtggtatgggctcgttcaacgcatcgaacgaacctttgtttgtgatagacggagttcccgtcacctcgggaaacctaagtaccggaagcggttcggaggcctcctacatgaacaatgccaagaccaacatcatgagtacgatcaatccttccgatatcgagaatatcacggttataaaggatgccgccgccgcctccctttacggttcccgtgcggccaacggtgttatcttgatcacgaccaaacaaggatcgaaaggacgtacccgggtcacgttgaacgctagcgccggattctcggacgccgcggtagacttccgcccgaccctcaacggagagcaacgccgggaactactttatgaaggcttggttaattacgcacaagaccagatcgccaaagatcccgcatctttcacccagactccggaagagtacgccaacgccaatatcggggcatacacctctgttcctgctttaggctataccgattggaaagacgtgttgatgagacaggccgtacatcaaaattatgaggcttccatttccggcggttccgagaacacgacggtctacagctccttgggttatcaaaaacaagagggtctggtggagaactcatcgatggaacggtactccggacgctttaacgtgcaacaaaagatcggcaaacgaggcgaggccggagcgaacctcatgttctcgcaagtgaatcaagagatgaacgaggaacgtacatccagtatcaatcctttctattgcatggcggtagccactcctccctcctacccggtatttaacgaggatggttcctacgccaatacctatcccggaacgaacgtaaatcctttgcgggatatgcgtaccgactataaccgggttcgtatgacccgtatcttcggtacggcgcacggtgcggtagagattatcaaaggacttaaattaaaggaagtactcagctatgattatagcatccagaaggatgcccgctatttcaacgcattaagcggggcgggtcccaagagcggtagcgatgcccaatcgtccaaaggttttatcgaatacgggaaattgatctcttctacctcgttgaactacgtaaggacattcgccaacaaacatcatctggatgtactagccgcttatgaggcggaaagtttccagacggataaagccgccggtgagaaaagcaagatgccgtccgaccaattattcgagccggacaatgccgccgttataaacagtttcgtatcctctacacaggattatcggttgctttcttatctaacccgcttgaattatgattacgacaaccggtattatatcgccggaagtttccgccgggatggtagttcccgattggcaccggagcatcgctggggtaatttctggtcggtctcaggcatgtggcatctgggagccgaggatttcatgaaagccgtaaagccggtgttgagcgatgtcaagatccgtgcctcttatggcgtgaacggtaatcagccgggatcttattacggttatatgggtttatatagttacggaaagaactatatggataaccccggttcgtatgaaagcacacaagccaatcccaatctaaaatgggagaagaactataatatgaacctcggactagacctcgcgtttatcgatcgcatcttcgtaacgctcgagtattacaatcgtgacaccaaggatttgctttacaaccgtccgatcagcgccacgaccggattcctgaactatctgggtaatctggggcagttaaacaataaaggtgtcgagctggaggttcgttccttgaatatctcgaacgcagattttaattggactacggtattgaacttgacacataacaagaataagatcgtggcccttgatggtaatctcgatcaagtggtggaaagtagttggtttatccggaaaataggattgccattcaatacattctatgtaaaggaattcgccggggtagatccctcgagcggaaatgcgctgtattataaaaatacggaagacgagaatggcaatctagaccgcaccttgacccaagatgtcaatgaggcgcaagcggttccttataaacaagtagatccgaagatatccggaggccttaccaatatcctttcttataaatggttcgacttggcctttacgctctcttattcattgggcggctattctttcgacaagaccggtacgtatatcgagacagacggagccagcgaaggaaaccgcaacctgcccatctatgagttagaccgttggcaaaagcccggtgatatcaccgacattccccgtttcgtattgggacgctccgacaaagtgagcggtggttcttctcgcttcgtacatagtacggatcacttgcggttaaagaacctgacgttcgggtttaccctgcctcataactggaccgataaagtcttgctggataaagtccgtgtctatttctccggcagcaacttgctgacttgggcgaaatggaagcaatatgatccggaagtgcccgtatccggcgaggtattctgtgagacaccgcccatgcgaacctttagcttcggcgtggaagttaatttctaaacacaacaattcattcgataaaaaagaaatacaatgaaatggtcaattaaatatatcgtaagcgctcttcctttcttattcacggcttgctccggagattggctggatctggatccctccacttccgtgaccagcgataacgctattcagtcactggaagacgctaaaaccgcattaaatggaatctatcgcatagcatccgagcatagttattatggagacaactacctctattatgccgactgccgtggcgaagacgtacaagctcgtattgacaaaggtcccggcagacgtgtatctccgtactatctgttcaacgtagccgccgacgacgcttttaatatcacgagagtatggaaccaaccctatatcgtgattcatcaagcgaacagcttaatcgagaaaatagacaacggtaacgtccaaacctccgacacgcaagaaatcgcccgtataaaagcagaggcgttggctatgcgtggcttagccttattcgatttaacccgcctctttggcatgccttatacactggataatggggcgtccttgggtgtgcccatcgagatcaagacggagttgccgactcaccaaccgtctcgcaacacggtagccgaatgctacaaccaagtgatcaaagacctgaccgaagccttacccaaccttgttacaaccaaatccgacggtcaccaaaatgtatggagcgtgaaagcacttctatctcgtatctatttatatatgaacgacaacgagaacgcccttaaatacgctcaagaagtaatcaataacggaggtctttataccttgttcacgcacgatgagtatacctccgtatggggaaaagacttcaattccgaatccctgttcgagttctactttacgcttaccgagccttccggcggtagtggcggagaaggcgctcccatggtatatgccgataacgtgaaagattggaacaatttggtcttgacgaaagatttcttggatttactgggtgaagacccggatgatgttcgccatgccttatgccgcttacctcaaaaaccggacgaggatatccttccaaccggttcgaccggacatcctaaatatctgacgaagtatcccggaaaaacaggagatgtattgaccggcaatccgcaagacaatgacctatgcatcatccgtctgtccgagatatacttaaatgcggccgaggcggctttcaagctaggaaaacgtagcgaggcgttaggctacctgaatcaaatcgtaagccgagccaaccccaataaatccgttagcgactccgagctttccctagagagaatccttaaagaacgccgcaaagaattggttggcgaaggacatgcgttctttgattacatgcgtaacaatattccggtaatccgcaagggcggttggcatttgccgcaattacctaccgacgcacaggtgatcaacgcttccgatccccgggtagcactcccgattccgcaaagcgagatcgacgcaaacccgaatatcgtacagaataaacggtaaccaacaagaaaaaggggaatggcattaaaaccattcccctttttcttgtttcgcttatttctttttcaagatccgttgcgccgaatccgacagcaccacgatcgcaccggccagtatcgccgtatcttttatcaccaatcgcccagcccccgataataacgggaaaccaaattccccgctgccgagattaggtacccagacctccggagtcgtgaccaagaaggacaacgtcccgaacgtcatgattatagccaaccccgctcctaccaaaccgatcttcggcgagaaaatgccgaggaaagttaagataccgatcgccatgatcaagattcccaagccacgagagaagccatacgtgttattctcttgatgccactcatgcttcgcttgatcgaactcaccctcttttaatttatacgtcttatattcgggagcgctttttgtatagaagaaactcatgaaagggctgttcgccacaaacggaacgatgccttccgcttcataattccagaacttcaaaccgccgatccacacaaatatgatcaagatcgatatacggatcaaattaatacctagcttctgagtagaggccgccacttgcaaaaacgagtaaaacaggtcattcaactttttcatcttattatttgttttatagtattgaacttataccgcaaagatcggtagaaacacctatcccgtaaatggcgattttaccggatgagttagcaattattcctgtttctctcttttccggtactcagagacgctttctcccgtcattttcttgaaaaaacggctgaatgtggcttgatcctcgaagcccaagatctccgtgatttccttcgcactcttctggctatataatagcaatcgtttggcctcagcctcaattcgttcatgaatgatccgcaacggggaaggtaatccgcaagtcgtaaaaagattggataaggtttttggggagcgatgcagcatattcgcataatcttggaccatcttcttttctttaaaatggttatctaccaatacatagaactggcgaaccatatcgaacgccttttcccgttccgggcttaccgaaaacttctcacgtgcgatccgggtgcacaaaataatgaaacgtttcagtaagatacgcagcatctcctcttgcaaattatcctttatggcgtactcactcgttaggctgtcggtgatatcgcgcaaagaggcaacttgggattcgctcaatttcaattgcatcacattggaagtcccgttaaaaagaaaaccattacacgacacctcattgtcatgtccgaaaatacaatagaagttactgttaaacagaagggtcaagtactcgccattgatcgccttgaactcgatatggtgcaaaggagtcaagggaataatctcacctttcactaaggtagtcggtacgtgatcgatctccagtcgcaacgaaccgctttgtacccaaataaacttgtaaagcgtattatctttctgcaaagcaaggttcgtgtgatacgaatcggtcaacgctatattacctcttaagcgagtattaaaaatatattccatagatttcttccggattttaagacggataaagataacaatattatataaacaaaaagcgaaagttcactttattcccagcaaacttccgcgtcactaatccccaaaacacactatacgagttatttcgactctaataaaatatcatctaccaatttcttcaactcattcttcggcatagccccttgaaccatactcggttctttcttcatcggtacaaacaataaagaaggaatactacggataccgaaaacactcgctaaatccgcctctttatcgacattcaccttatatacgttgattttaccctcgtactctttgctaatctcatccaagataggagacatcatcttacaagggccacaccaagtggcatagaaatcgataaccgcaggtttatcaccctcgaacttccaagcgttcgggtttgtctcaaagtcatacactttctttacgaaatcttcttgtgttaattctgttactgtcattttattttctgttttattgttattattcttatttccattactagcgttcgccattcctaccaaaagacttgcgaacaatacgacacctaccttaataaaatccatcttgaacctcctttttattattattactttgtcttctatttatattgcaaagttcatcttatttccacgattaagaaatggccatatcgccggataagtttgcaatacttcccgatccccatcaaaaaagtataaaataagttttttcaagataaatgccgaaccttggttaacaagatccggcatatcgtacattctttttccgtaaaacctcaacgatctacaaatgcaactgcaagccgatagaaaccggatgcaccttcggacctttcccattttcaaagaggtcgatcggtgagtacttggcgtaaagaccgatccaatcccaaccggcttgaaataagaaatccatagttaccggacggatattcataccggaatccattttctctttgtgctttttaccggaagcgtcattatatacgatcttcgaggaagaacaagtcttgatcacaccgactacacccgcagacaagaagaattcactcgaacgctttttaggttgccattccaataacaacggaatggtcagactcgtgatattcaacttactcgctttcaacgtaacaccctcaggagccggacgtaaagccgtaacaccgtctatctccttgaaatactcattcgaatctatacggtaacggctccaacgcataccggcaccgatcaccaccgcccaacgataccgagagaacgggaacgctttttccaatacattcaaattatattccaatgagtttccactacgaagggagactccgtctacatcatttacatgtaaactcccatccgcgaagttcgcgaagcccattccaaaaccggcccaatgcggattgaagtctttatcccaagtaggcacagggatattgatagacttcacgtgtttacggcgttcatagctttgtccgtcccggtaatgcccttcgaagatcaactcgtcgtccacggaatcaccatcctcgtctacctcatacaccctgactttcatgcgatcgccattatctttcacctcgatacgttttctctcaagggtgataatcgtatccccagccaaaggctcaacctcagcggccatcaacccgattaccgggaagcaagccattaagactaaaagtattcttttcatcttcctatctgttttgtttgtttataaatctttcttcgtaaataatagcgtgattaaatcatcactatccaaatctccctcaatgtacaccaaggttattacccctttcttgctgaccttaaaaaggacaaaacggttgatatctgcttctacgcccttcaactggtaataagcggagactacccctccatcgtccgtcacctctttgatcttccgggcccctttctggtccgcttccagacattggcgggtaaaccgcagggcttccggatcatctttgatcgtaatactcttataacgagtcatgccatacgtttccaacatctcgttagacaactccaccatcgtgacattacgttttttgccatatcgttgaaagacttcctgaatcttcaagtctttctgtgtctcggcagccgagacaccacaaggcattaagcaaaataccgccaccagcaaccataacatgtattcgaaccgtctcatatttacagtatttttattcattatcatcaaataaagaacgaagctcgttcaattggttatcaataatcatacggtcggcctcatcacgatccgcttccggaaagtactcgtccgtaggtgtggccacctcctgcaaagcttccagcgccatggagcgaactttatgaatatccgtataacaacgaccgtttataacgacataattatccgagcagaagcaaggatctaccggattcaacagatggttaagccccaaaagcagcaagaaactggcggcgataccggataccaaatacaacacggatcgtaaagtaaacgtcttcttttcctccaccttttccgcatccagcataaaaaggatatcctcatcaatcggaatcaatgcctcatccggctgtcgttccttccgactctcttcctccaaataggtaaacataggcgtatagaccgccaacctgtccggaacattcccggaagtaaagaaggctcgaagttcccgctcttcttccgaagaggtttctccttcaaaatatcggtttaataactcgtctatgtccatttctcttgtttatttaattgtaaaaactgttcccgtatctttttccgagcccttgagagattcacccggacattctcgaccggtgtagccgtgatctccgcaatctcggctaactcatagccctctacatccttcatccggataatggtttgctgcaaagcgggcaactgggcgatcaagtgccgtatgcattcggcggcatccctttgctccagttgttcgtcggggcttaccgcatccgataccaacgtaacgctctccaactccgatccctgcggctttcgcaactttatcttatccaatgagagatttttcgtaacctgcatagccagcgcctccacgctatggtaggcatccagtttttcccggatataccaaagctttatgaatgcctcttgcaccacatcctcagcatcggctgtgtcctcaaccagtctttgggagaaattcaacatcttctgccggagaggtagtacggttattttaaacgtctcaagttccatttctataatcaagacgacaaaggaagaaaaacatatcatggaaaattaacttatttggaaaaaactttgcctgtcacccgcttgtttgtaatagaaaacttaaacgttatgaaactaaaagtatcatttacagccattttattcatgagctactgcttattcctcaccgtaggttgccaacaaaagaaacaaggttccgatgacaaatcggtccctcaagcgattcaaaaggttatccagatgaaatatccaggggcgaccattaccgattacgataaagatgccgcaggtgtagaagtcgacatcaaggataaaggcgttaagaaagaggttctgctcggcaaaaataacgagtggctaagcacgaaattcgatatccatgccgaagatgttcccgtagacatcatggacaacctaacaaattcggcttatcatgaatataagatagatgaggtgacacaaatagacaagccttcgggaacattttacgtattcaaactagagcatgagaacaatgaggttcgcctcacgtttaactcagaggcccaattattgaagtagaacggtactgaatcttttcttattccagatttttaccagaatatttcagtagctttgtatgattaacaagctagcctatgaaaattctggtagtcgaagatgaaaacgcattgagagaagttatcgttctttctcaagagaacgaacgatatgtgatagagagcgcttcctctttccgggaagcttctcttaaaataaatgattatgattacgattgtatcgtattagacatcatgcttccgggaggtagcggccttacccttttgaaggaattaaaggccttacgcaagaaagacagcatcatcattatctccgcaaaagactctatcgaggataaagttacaggattagatcttggggccgatgattatctgaccaagcctttccatctggcggaattgaacgcccgcatcaagagcgttatccgccgcaagcaacaagatggggaattgcaactgtctttagcgaacctaacgatatatcccgataaacattccgtctatataaacgggaaagagatcgtattgaaccgtaaggagttcgatctgctctactatttcatatccaaccccaaccgtttgatcagcaaagctactttagccgagtccgtctggggagattatatagaccaagccgataatttcgacttcatctatagccaagtaaaaaacttgcgaaagaaattaaaagccgccggagccatccccgaaataaaggcggtctatggcttcggttacaaaatgaccgacgaggaataaatatgaagctaatccattacaccctccgcaatttatttgtccccatattggtcattttcgccgcttggggatgtgttttctgccttatgattctacatgaggtagaagacgagacgaatgacagccttgagaactacaaagagattatcatccgctccgccttagcggacagcacattgctgaaagatcatgtggatatcatgacccggtactacattcgtgaggttccggaaagcgaagcgaaactagataaggacgagttctacgatactacggtatacatagagatagagcaagaatacgaaccggttcgtgccttacgcacttatttcatgacaaaagatcgtaaattctacgaactgacgctggagttatccaccttagaacaagaagatatgatcgagacgattatctggagcatggccgtcttatatatcgcattgataagttgcatcttattcgtgatccatcgaggattcaaaagaagctttaagcctttatataagctattaagctggctgaaaagttttcaagtaggcaaatataatcctccattaaacaaccctacacccatcgaggaatttaagatattaaacgagaccgttcaagaaagcgtcaaccagagtgacaagctatacaacaaacaaagacatttcgtagagaatgccgcccacgagttacaaactccattggccgtatgcatgaacaaattagaattattaagcgaacatccagattgcacggaagatcaactgaaagagatcgctggcttgcatcaagcgttgaacggcatcatccggttgaataaatccctcctattactttctcggatagataacaaacaattccccgagacccgggatatttgcctaaatcatcttatccataagatattagaaggaattaatgacatatacgaaagaaaagctctccacttacgagtttcagaaaaagagagtttggtatgcaccatgaatgaatcgctggccactacgttaatcaccaatctcattaaaaacgcctatgtccataattacgagaaaggggatataggaatcacgatctctcgccgtatgcttacgatcgcaaatacgggaatcgacaaaacccttgataaggaattattatttgcccgttttgccagccaaagcaaacaacaagaatcgacgggccttgggttggccattgtcaaatcaatagtcgatctatattcgatccggatagattaccaatacgcaaatggtatgcatacattcacattattattctattaacggccgaaattcccaattttttccaaaatgcatccttttctttgcggtataataaaaaacaaggcatatgaaaaggatcaattatttactgatagtcttatcattattatctgtcatggcttgtgccggcaacgataagatcacgagtgacaccaacgtattgccggtttccagccgccaattcatatcggatcattttaaggacatcccggtatcgcatatccaaatagagaaaaatctgatccggattagcagttacgacgtgatcctcacggacgggaccaatgttgagtttaaccataaaggagaatggaaagagattaaacggcatgggctccctatcccgcaagcgatcattccggaggtaatacaagaccttatcaagaaaaactattcatcgaataaggttgttaaaatagaaaaagagatacgggattatgagataaagctagataacggtcttgagatgacattcgacttaaaagggaacttgattgatatcgatgactaatagacactctaagataagtattaatatatttttaattaaaatcaatcgtatgaaaacaaaagcattcataatggcaactttggtttgcagctcattcgtattcatgtcatgtgatgacgatgatgacaaattcacacctgagagtattgtaacaaaagcctttgacacaaaatatccggatgcgcaacgtgtcagttgggagaacgaggcaggctatgtcaaagcagaattttacaccggttcatatgaggctgaagcgtggtttgatccgcaaggcaactggatgctgacagagaccgatcttccttacaaggctttgccccaaaccgtaaaaaacagtttcgaggcaagcctatacgctaaatggaagatagacgatgtagatatgctagaacgtccggacgctggtaccatttacgttctcgacgttgaaaatggcgagcaagatgcagacctacattatacggaaggcggtattctcatcaaggaagtaaccgatggtaacggcgacaacgagcatcgtccctccgttacccccagcgctattaaggaactcatttcagagatgtatccgggagcgacaatccttgagatagatacggaggcaaaaggtaccgaggtggatatccttcatgagaatatccataaggaagtttggctggatacccagaacaaatggttatatacagagtgggaaatacgctcttcccaagtacccgatatcgtgatgaccgcattcaaggcctccgcatatgcctcttatcgaatcaatgatatccatgtcattcaaaaagcggaaggactctcttatgagttcgagctggagcaaggagaccgagatataacgattctttttaatgaagaagggatcttagtctctcctacccattaaaaaaagactctttatcgcagtactactgcaacccacgtgcagtagtactgcaaagcgggttgcagtaaaacctcatgaactatatcggagtggatggataaggaaagaattactgaaaatgatatttctgccacgtatagactttcggttcactgagatacggctctattttctcacgagcctcttggctcagatactgaggagtcgtataaatggcggtcaaagtctgatcatccggactcaatcgatattgaattaaatccatatccaaatgtgaggcggcctcttgataggcttcgtctttcttatccattccctgcttgatataccaatcggaagttggctgcgtgaataaatcggatgttgccaaaggctcccaattggtcgtgaaaaactcgatacggctatccggaaccgggccgtttaccgtagagatcatacaaaccacgtaggtattgtttaccaagggaagtaatttcatctctaccgtgctacgctccgtagtctgtagcaaaaggtaatcgttcgttagcttttgcaaggtagaaaagccattcatcgtatttttcagccgggattcttttcctgaagtataaagatccaccaaatcctttcgccaagcgtgctccaattgaggaatgtattggtctggcatcgccgtgaacacacttgtcatatcctgtgcgttcattcccaacgcaaagacacagatcaacaacgtaactataactcgtctcattatctaattttctattttgtccccaaatataggaatatcattcctaacaacacaaggaataagtcgatcgccttgttctttaagtttttttcatggaagaagatggctcccgccaagaatgtcaccaatacgttactccgacgtaccatcgatacgatcgagatcatggaatccgggaatgtcaaagcataaaagtacacccaatccgccacgcataagaatacggagataaagatgatattccatcgccattggaaaggcgtgctctttttccggttcggataccatagaaacaacaggataaatgacatgataacacattgatagacattaaaccagacttgtaccgtcattacatccatactacgcatcaaatgcttatcatacaatccgctcatcgccccggtcaagatagacaggaccgtgaagaagatccatttattatgggcaaaatgaatcccctctttcttccccgatgaggaaaggagataaaaggaagcgatagaaagcaagactccgacccattgaaatagattcagccgttccccgaacagaagcatcgcacccagtaatgtaagcacgggctggctggccttgatcggcccggttatcgtcagcggcaaatgtttcaaggcaaaataccccgatatccaagaggataagacgatcaccgcctttatcaataccttcagatggtcctccagagaggcacggggtacatacaccatcgtcccgtccaagcaatccgtataaaaagagagcaaaatgaacgggacgaaaatcaaactgcttatgagcgtattgaagaataaaacgggaataacggcattcccatttaacgacattttcttattgacctcgtaacaacctaacaagaaggcggagaggaaggctagagctaaccacatggtttaaccctccactggaaagagttcttccgggtacgtgacgtctaccaagaacagggcgtgtcccggcacggaggttccggccttgcaacgatcctttgcctcaatcacgtttcggaagccgtctatcgttaaacgtcctcttccgacttccaataaagtaccaacgatcgcacgcaccatattacgaaggaaacggtctgcacggatcgtaaacacccaaatatccccttcttgcgtccaacccgcatgttggatatggcaattattcgtctttacatccgtatgcaacttactgaaactcgtaaaatcgatataatcgaataagaccttacacgcctcgttcatcgcctcgaaatccaaacgaccgggaagcttataaaccagctcgtaattaaacgggtctttccttgtagtaatataatatttataggttcgtgaagtggcgtcgaagcgggcatgcgcttccggtacgacaggcacgatcttataaacggcgatatctttaggcagcagcctatttaatttttccgcaaggaaagccaaatcctcgatcggtccttcccaatcaaaatgggcgatcattaagcgggcatgtacaccggcatcggtacggccggcccccacaataggcacaggcttacgcatcaagatggccaaggcctcctctatagattgctgcaccgtcataccattcggctggatctgccaaccccaaaaattctttccgttataccccagatacataaaatatcgtctcacgcttatactctttactttatcttttctaaaatatggtacaaaggtacagaaatccagccaagccgttgcctgaatggactaaaaagtttaattttgcatctttaacagcttcacttcaaaactatctgacatgtttgaaacattacttcagtcttcttattttgccctgtttctgatcatagcgcttggattcatgctaggccggatacagatcaaaggtctttcgctagatgtatcggcagttattttcatcgccctgttattcggtcattttggggttatcatacccaaggaattagggaatatggggttggtgttattcatctttaccattggtatccaagcgggccccggatttttcgactccttccgttccaaaggcaagacactcattatcctgacgttattaattgtcggttcggcatgcctgacaggaatcttattcaagtatatcttggatatcgataccccgagtatcgtcggtctgatcgccggggcattgacgagtacgcccggtttggcggtagcgatcgactccacgcaatcatccgccgcatccatcgcctatggtatcgcttatccgttcggcgtaatcggcgtgatccttttcgtgaaactattgccaaaaatgcttcgcaaggatttgatagccgaggctaaagtgctggaaacccaacggaaaagccaatatcctacattacataccgccgcatttaaagtcacgaataaaaacatctgcggaaagagtttggcacaattgcaggtacgggccatgaccggagcggtagtctcccgtataaaacacgacaatgtcatatctatgccaactccccataccacgctttacgagggagatttactgaaggccgtaggtaacgacaaagccttggagcaactgacattattgttgggagaacgtatcgagggagatctgccgttaagtggcggacagaccttgcaatccctgttactgaccaataagagcattatcaataaatcgctaggccatttaaatttacaaggtactttcggctgtacggtaacccgtgtacgtcgaagcggaatcgacctttccccggaacctaatttggtgttgaagtttggagataagttgatggtcgccggcgagaaagaaagcgtaaatgaactcgcccaattcattggcaatgatgagaaacgtctttcggatacagactttttcccgatcgctatgggtatcgtattaggcgtattgtttggaaaattaaatatatccttctcggattccttctcattctctccgggactaaccggcggtatccttatggttgccttggtattaagcgccatcggaaaaacaggtccgatcatctggtctatgtccggttccgctaataacctgcttcgccaattgggattattgctattcctctccgaggtcgggacatccgccggtgtaaatctggtttccactttccaatcaagcggtttaactttattcggagtcggtatcgctataacaatgatccctatgattatagccgtattagctggatattatttctttaagatcaacattctcgatttagtcggaacaatcgccggcggtatgaccagtaccccgggacttgccgccgcagattctatgacagacagcccagccccaagcgtagcttacgcaacagtttatccgatagcgatggtattcttgatcttgtttatacagatgatagcgaatttgatcgtctaaatattatacgtacatttgtgaacacacctaaaagaacttaaatatgatgcaaacaaatttacaattggaccttgccttcaactatctggaaaataccggaaccaacatcttccttaccggaaaagcgggaacaggaaagaccacattcttgaaaaaacttaaagagacttccccaaaacggatgattgtggtagcacctaccggagtggcggcgattaacgcgggaggggtaaccattcactccttctttcagctacctttcgggccgtatataccgggtagcgaaatggcctccgggcaaaataaatcctattctcataaattcagccgggataagatcaatatcatccgtagtatggacctgctcgtgattgatgaggtcagtatggtacgtgccgatttgctggacgctatcagtgatatgctacgtcgttaccgggataggaataaaccctttgggggcgttcaattattattgatcggagatttacaacaattagcccccgtagcgaaggaggacgaatggaatttgttgagagaacattacgcctctcccttcttttttgacagtaaggctctttccgaaagtgattatctttgcatcgaattaactcaagtatatcgccaagcggacgatacgttcgtccgcttattgaacaatatccgggaaaaccgcttcgacgagaatacgctacacaccttaaaccaacgttatatccccaattttaaaccaaatgacaaagcgggttatatcacgctgacaacccataattatcaagcccagcaaatcaataaccggaagttgcaagaattacccggcccggcttatacgtacaaggcggagatcaaggatgactttccggcttactcctacccgaccgacgaggtattggagctaaagcaagacgctcaagtcatgttcgtaaaaaacgattcttccggcgaaaggcgatattataacggaaagatcggccgaattgtcttcattagcccgagcaagattatcgtatccgacgaattaggaaacgatatcaccttagaccgggagacatggacaaacgtgaaatatacaatcgacgagaacacgaaggatatcacggaaacaatcgccggctctttcagccaatacccactgaaaaccgcttgggcgatcacgatccataaaagccaaggcttgactttcgagcatgccatcatcgacgcatccgccgccttctcacacggacaagtctacgttgccttgagccgttgcaagacattggaaggaatggtattaagtagcccgatcactcgaaacgccatgattagcgatgagaagatattaagttatacctcttccctctcggagcgtcaaccgtgtgaagaccaactgcgtcaagcccaacaacagtattatttgagattggcaaccgagctattcgacttcaatcccgtacaacaaaagttgcaatatacatcttacgcggcatacacccatctgcaaaaactatacccggaattaagcaaccaatatccccgggtacgggattatttccgttcggatatagtagaagtaggcgaacgtttctgccagcaactcacccgtatgatctccagcacgaatctctatgatacggacgagcatatacaagaccgcatccgaaaaggttgcgcttactttctggaaaagatcgagacctattgcctccctttgatagaggcttccgatgtagagatcgacaataaagaggcccgtaaggcatttacatccgcattaaaagctttcagcgatgagcttacgatcaaggtcgctacattaaaagcctgccaagatggttttcgtctcatcgactatctatccgccaaggctaaagcgaacattgaggagtcggctgttgccagcaagcggaaatcgacgcggaaatcgacggaagcggaaaagatccccgtctccatggatgtcttacatcctgagctatatgcccgtttgaaacaatggagatacgaacttgccgtagaaaaggagttgcctccttacacgatcttgcaacagaaagccttaattggcgtttgcaacactttgcccacgaactcgaaagaactgttgaagatacccggaatcggcaaaaagatcatagagaactatggtgagaccctattagaaatcgtatcttcctactcaccttccacgcatgggaacgggctgtgagatacggagacaactcacgatagcggcgactaaagcgaaaccgaccgctacatacatacaaaccggcatactatcggtcgcagaggtaacactaaagatcaaagcgacaaatgtcgtccccagcgtttgccccaacagtcgtgccgtaccttgcataccgttcgccccgccactccgggaacgaggggcggccgatatcatcgtgctattattcggggtctggaacaggccgaagcccataccgcaaagcatcaatcgccaagcgatgtccatattggtgggttgccccggcaataaagccaatagaagaagtccggtcgcatacaccaccattccgataccgcctaacaatccgggatgatatttctcgatcagcctcccggctaccggagcggtcaagatcgtcgctactggccaaggagtcaacagcagccccgtctccacctcatttcttccggctacattttgcaaataaaagggtaatgataccatcgccaacaactgtgccgtaaatgaagtaatcgaggataatacggacaaggcgaatatcggaatccgcatcaagtccaatggcaatatcggaacctcctgccgtagttgcctgcggataaaaaatgttccgatcaccaatagaagaagaacctgtaaagcgatcattctccagttctcatgatgggcgatgccttccaacgaataaatcagcaatccgaaagtcaaggcattcgagattccaccgatcttatcaaactttcgtttcggcccatccttgcaaggattttgaggcaaaagaaaataacccgttataatcgcgcaaatccctaaaggtacgttgatagcgaacaaccaattccaagaagcgactgataagatagcgcccgccaacgacggcccggcagcaatcgataccgccacgaccatggcattgatactcattccccgccctatatattgaggaggataaataatacgaagtaaagcggtcgtcacgctcatgatagccgaggctccgatcccttgcaatattctcgcgaccgtcaacatggcgaaagacgaggataaggcacagaataatgacgttgagcagaatattgtcgtcccgatcaagaaaatccgcttatatccataaatatctcccaaagcggagaatgataaaagagacatcgtaatcgtcagctgataagcgttgacaatccaaatcgtggtggaaggggatgtcccgaattcacgggacaaggtaggaagcgccacgttgacaatcgtaccgtccaacacggacatgatcaatgccaacgcaaccgctattactgcccaataacgcctcggtataaatcgtatcatattacattatttcttcaaatcgaaacccagcatcatgccatcatattcacttgccaacttattgatagctttcaaggtcgtattgctagatatagaagaaaccgtgctcaagaacttcagtaatttgtccgcgttaaaaagcaatgtcaactcattaccagaaaggacgacatgggcggtaagcgtagaaacggtcagcttcttattacccaccgtataccgtaacgtcaccgttttatcttccggactcaccgagtaagtacctttcaggcttccccttttcaatgcgctcgtaaacgtactatccgaattaaagacataattaaatacaccttccacgatacctactttcgcgcaatattccttcattttcttctctgcctcggtagccgccaagcttcccgctacattcttcaaggcattatcaccttccagttgcagggcagggttcacatacatccaagttccctgtaaattctcgaaagtcacggctttccctccggtgacagaagtcacggcgttctttacggcagatgaatttaagatatctttcaaggactgtcccttcatgtttccgggaatcaacaaaaggccgcatacggccatccacatacatagtaactttttcatctctttgttttttactcaattagaaaaatcggccaaagatacgaatattattcatacatttgttttaaataactttatacaaacataccatgagaaagcaagtcgtacgtatttgtatgttactggcctgtgcctttggctttatgcaagggcaagccagcatccagccttctatcgtaaaagctacgataaacgagctaatagccaaggacgctaagaatcaagcaggaatcacgaagggtgtcgagcaagtagcccgcctctggcaaacctccgatggggatgagcaagcgtttcaaaccttctgccgggagaattatctatccgatcccgccgaaaaagaccaagttttcctcaagatcagcgagtatcttgaaggtatcaatggcaatttcaacgagatggtactctgtctgcaacgaaatttgaacctagataccggacctctacacgccatcgatgagaaattcgggtcctacagccccagttcccacctaatggacgatctatacgccaacaagatcggcttcatcatcgccctcaactttccccaacttactctcaaggagaaagaggcgttaggtgatgaccgtaaagcatgggcctacgcccgtctgggcgatatgtttacggaacggataccggcggaagtaaagcaagccgccgcagatacggaaagtgacgcagatatttacatcgcggattataatatctatatggggcatttactaactcctaaaggaaaaaccattttcccctccgacatacgcttactttgccattggaaccttcgcgacgagatcaaggccaattataacaaaggaaaagagggattggaaaaacaacggatggtatatgaggtcatgaagcgaatcatctcgcaagaaatcccgaaagaggtgatcaactcggatcgttacgaatggaacccgtacgccaatacgttatctcaagcaggaaatgaactagaaggtacccctgaaagcccggcccgctatcagaaaatgttgaataacttcaacgccatgcagcgtatagacaaatatacgggaaacacctatatagaccgtaagttcacggaagatatggaaatagatgtcaacgatgtagaagccctgttcgatcagttcctttccgcccccgaactaaaggaagtggggaaaatcatctccaaacgcctcggacgcaaactggaagcctacgatatatggtacgatggcttcaaggcccgtagcaatctggacgagaacaagctaaacgagcaaacccgtaccctgtatcccgatgcggtaacgatggaaaagaagctaccggaaatattacagaaactaggattcagccccgatcgtgcccaatatctagcggataagatcgcagtcgatcccgcccgtggttccggtcatgcgtggggagcctccatgaaaggccagcgttcccgtttacgtacccgtatcccttcacaagggatggattacaaaggatataatatcgccatccacgagtttgggcacaacgtagagcaaacgatctcattatatgatgtcgattattatatgctcaacggagttcccaatacggctttcaccgaagcgctggcctttgtcttccagaaaagagaccttgagttactgggcataaaagacgagaatccggaaaaagaaaagatggatatcttggataagatatggagcatgtatgagatttgcggtgtttccatgctggatatctccgtatggaaatggatgtacgcacatcctaacgctaccgccggggaattgcaggaggccgtgatccgtctttccaaggaaatctggaataagtattacgctccggtattcggtgtgaaagacgagaccgttctagcgatttactcccatatgatcggttatccgctctacctttccgcctacgctttcggacagattatcgagttccaacttgagaactacctcaacggcaaggatttcgcgaatgaggttagccgtatcttcaagcaaggccgcctcaccccgaatgtgtggatcaagcaagctaccggcaacgatcttaccgtagatccgatgttggaagcactccgtaaggtattaaaagactaaactacagactaaaagaaaagccatcccgataccgagatggctttctttatttatatcaagaaacttccgattataacttgtcgttagaaccaagaacgttgatgatcttgtgtttgtaaagtttctccatgttatcacgagccgggcccagatatttacgaggatcgaattcagccggtttctcagcgaaagtcttgcggatagcggcagtcatcgccaaacgagagtctgagtcgatattgatcttacatacagaagatgtagcagccttacgcaaccactcttcaggaataccgatagcagccttcaaagcgccaccgaatttgttgatagtctcaacctcttcctgaggaacagaagaagaaccgtgaagaacgatagggaatcccggaagtttctccataacagcgtccaaaacatcgaatgccaatggaggaggaaccatcttacctgtaacagggtcgatcgtacattgctccggagtgaacttataagcaccgtgagaagtaccgattgagatagccaaagaatcgcagcccgtacgagtagcgaagtcgataacttcctcaggattggtataagtgtggtggtctgaagaaacctcatcctcaacacctgccaatacaccaagctcgccttctacagttacatcgaattgatgagcgtactcaacaactttcttagtcaaagcgatgttctcttcataaggaaggtgagaaccgtcgatcattacagatgagaagccagagtcgatacagctcttgcaagtctcaaacgtatcaccatggtctaagtgaagaacgatctgaggattcgggcaacctaattccttagcatattcaacagcaccctgtgccatgtaacgaagcaaagtagcgtttgcgtactggcgagcgccctttgaaacttgcaaaataaccggagattttgtctctacagcagccttgatgatagcctgcatctgttccatgttattgaagttgaaagcaggaatagcatatccgcccttgatagccttagcgaacatttcttttgtgttcaccaagcccaaatctttgtaatttaccatagttgttattatgttattacgttaatgattaaaaacttgcacaaagataatcaagattcacgacaaatgatgcttcaaagcatataaaataacacaaaatcaacgctcttgaaaaaaataatacgattttctttgtttgtttgtggcaaacccttacctttgcaagccaaaataccggttaccaaatatatacagagtataaattaaaatagataataaagcaatgaaaaaaggtattcatcctgaaaattatcgtcctgtagtatttaaggacatgtcaaacgatgatgtattcatcactcgttctactattaacgctaaagagacgatcgagatcgacggcgtaacttatccgttggtaaaggtcgagatctctaacacttctcacccgttctacactggtaagtctaagttggtcgatacagccggacgtgttgataagttcatgagccgttatggtaaccgtaacaagaaataagatttctttctttaagaaataaaaaaaggtcacgatttgtatcgtggcctttttttgtatcttcgcgggagttaacataatgaaatatcatggcaaaaacgaaagaacaattactaaacatcttggatcagttccagttggacgagaaagtagtttccgctgaaccattcggaaacggacacattaatgatacattgaaagtgaccaacgagaaaggggagatcaaatacgtgctacagcgtatcaaccatttgatcttcaccaacgtggatatgctgcaaaataacatccatgtggttaccactcatatccgcaaaaagctggaggaaaaaggtgaaacggatatcgaccgcaaggtattaaccttcttgccgactaaagacgggaaaaaatattatttcgatggagatagttattggcgggtatgcctattcatccctcgcagcaaaagctatgaggaagtaactcctgagctttcttatgaggctggcaaagcgttcggtgatttccagaccatgttgtccgatatacccgagggtacgctgggcgagaccatcccggatttccataatatggagttccgcttgcgacaattccatgaggctgtagccgctaatccggcaggccggttggaagaggtgaaagatttggtagaggagatcgagaaacgtgccgaagcgatgtgcatccaagaacgcctgtaccgtgagggccaattgaagaaacgcacgaaccattgcgatacaaaagttaacaatatgatgtttgacgctgatagcgacaaggtgctttgcgtgatcgacttggataccgtaatgccgggcttcgttctttccgatatcggcgactttatccgtaccggagccaatacgggtgccgaggacgatgagaatctggataacgtaaacgttaacatggagatattcaaagcctatacccgtggatacatggaaaaggccaaggcgttcttaactcctaccgagatcaaattgctaccttacggtggacgcttattgacttatatgcagaccgttcgtttcttaaccgattatatcaacggcgatacctattacaagatccatagcccgaaacataacttaatccgcacaaaagctcaattcaagctacttcaaagtctggaagcccatgcggaagagatggatcagttcatgaatcaatggttataatataaagtaactaaggaatataaaaacgggcggggtgactcattgattcatcccgcccattctttttatttcgtccaataatccaacaccgtaaccgccgatgccttccctcctaacaccttgccaaatgctttatgcgccggatgtaccaaataggcgtcccgatccgcatccgaatgaaaagtcaagaaaaagcaatgagtcaagccctgttgcaatccctccggactacaatccgttccccactcatatcctttgatcaagtcgatttgagaaggcaacttacaaaaggcatcctcaacctctttcacctgcgcctcggacacatccggcttaaaaccgaacataacgacatggcgaagaactttctccggcttttgagtattcgaacagcctaccatagataccgagaacgcgataaccgcaaggatagataatacagatactactttcttcatgatattcaagattagatttctattgctttgttatacgttgcaaagatagtataaaatccagtacaacttgtccaaaacctccatatcctttagccctttccatccttatctttagacttttcctcaagagacatccatcatctatcaactgttggacgatcatgcaacggctggtagaagatcatgcaacagttggtggacgatcatgcaacggctgtcgcatgatgaacacaagcagacaaaagggctaacatctgtaaggatacagcctaaacctacaagggaaaaacctaatactataaagggattattttcaagcgaaccaaatcttaaacctcgtcaatccatccggataagagcgaagagagaatcggcaatcatgttttaacagcacctcacggataaagatcaagccgatgccctgtccgttcggcttcgtagagaagaacgggctgaatagtttcgtttccgtatccttgtcgatgcccttgcccgtatcggcgatctccaagcaggtgggacgcactgtcgtccggatatagatctttccatcccgatcgatggattcggcggcattcttgataatattgaccaagacttgctcgaataaggaattatccaaattcacgactggagattcctcgctcagatccatgacaatctcgatattccggttctggcaaaccgtctccataaagcgtttgcaagcgaacaccacttggttcaattcttgcggacggctttgaggttcgggtatacgcaccacatcagcgaaattggtgataaaatggctcatgctataacaacgttctatggagacccgcaaaacctcgcagacatcctccatatcctccatcccactgaaagtaaactccagcgtatccaaggtagaggtgatacccgcggtcgtattattcacctcatgagagatcatacgtatcaccttctcatacgccttcttctcggccttgaacacctcttgggtcaacgtctctatcaaataaaattggtggtgaaaaccccggtctacgaatgaggaatgcgtacatttataaatattagcgtcgttcagccggacggtttgcgcttgatacatcggaacccgtaccaattcttccgccaagggagaatctagttgaagaaaacgttttcccaccatatcctccgagctttgcgcgccaaacaatttacacgcggccgggttcatggatagaatctcctcatccaagttcaagatgatcactcccatcggagaggcgttgaccagcaagtccaagaaatggttttgctcccggaggtgcaaacgctcattcttcaactgctccatcatcttattaaacacatcgaccacccggtccgcctccgtttgcccgacctttcccaagcgggaactaaagtcttgctctttcaacaactccataccgttaccgatgatatgcaagggctttatgatacggcgataaaagacaaataaatagatgatcgtaagcaagaccaaggcttctaccgcgaaaaacatccggatagaagacgtataaaagacataataagtcaccaccgccaatatagtcaacagtagcgtcgtcaatatccagaatagtcctttcagcctcatcctcgcctcttcttatttatcgatcgggattccgtatttctctaatctccggtacaatgcggcacgactgattcccagtgccgtagcgacatgcgataaattacctccatgcgcttccaaggagcgtaagatggtttgcttctccaactcatccaaggtcaagccctccaaagaagacggaatcgttgatttagagccggatgtattcatgcaatgaacctcgaaatcagcggcatccaaaagcgtcttacccgacacaaggatcgtccgctccaccaagttcttcaactcacggatattaccgagaaaaggaagacggcttaaataggtctgggcatccgatgagaactccaccctcggtagcccattgacctccgattgcttatccgcgaaatatcgggccagcaatgggatatcctcccttcgctcacgcaaggcgggtaaatgcaccgtgatcaaattgatccggtaaaaaagatcctcacggaacgtacggtccgccaccatcgatcgtaaatcccggttcgtagcgcttacgacccgtatatccaccttccgggggcggctatcccccaagacctcaaaggtctggtcttgcaatacccgaagcagctttacttggcaagacagttccaaatcgccgatctcatccaagaagatcgtgcctttgttcgccatctcgaaacgccctacccgatccatgtacgcgtccgtaaaagcccccttcttatgtccgaacatctcgctctcaaaaagactttgggaaagtccgcctaggtttacctttacgaaagcctctttcgaccgggggctattcgcatggatcgcttccgctatcagctctttacccgtaccgctctcgccggtaatcaaaacagaggcgtttgtcggggcgatacgcgagaccgtccccaatacatccatcaaagcggcactttgccccacgatcttatcaaaatgaaatttatggtcggcatccgaacggttcaagggagcgtttgtctctttcttctgctcgctcaattccaaggcggtccggatcgatttcaataataccaagttattccaaggcttcgtgataaaatcgaaggctccggcttgcattccctgcactgccaaagagatcgatccccaagcggtcatcaagatcacaggtacatcgggacgaaagatcttcacctgtctcaataattgaatcccctcctcgcccgtggtagtcagcgtgaagttcatatccatcaagatcagctccggcgccgtggcacggaccacctccaaggcctccttcggccccggaaccgcctccgaccggaaacccgcacgttttagcaggaatgtaagcgaggaacgaacagccgcatcatcatctattatcagtatcatataatcaatttatcgtttcacgatttcctcgaaatcggcatctaatgtacgattattcaagaaatcatacaatgttatactacggatgttataaaaataacgccagtaataatacagttcttggatatgcttttgcttcgcatcatccttcgaactctgggcgtcattcaagtctaggatatcgatctttccgatcatgaaagtctcgatcgaggtcttgtagcgcttttccgccaacgtgtccacctcggcggctatctccaattgagcggcctgattgttgaaattctccaccaagaggaagatatcttgattgaaatccatttgctcctgacggatcttggaaagtacgacatcccgattcgattcggctacttttaccttaccttttcgttttccccagtccaagataggaatcgaaagcccgacctctacgatctggttatctttcaacgggttgtaagctcctcgcatggacacatccttaccggtataacccacggaggcaaacaggttaatacttcgacggtttcccttggcggtcgccacatcataatccgcttccaactgacggcgcatgatattctttgagaacgagttattttcttgagccttctccaataccgcctgataatccatacggaccccttctatcgcctcgggaagaacaggctcgatcacgtcttgctcgctcatccctaaaaaggaacggagcttgaacatcatcgcgttataattggattgagcctcggttagcttacctttcgcttgcaaggccgactgtttcaaacgcatcaactcgctctccgagatatgcccgatcttacgcttcgctaccgctatgtcatagagtttattggcgttcagcaagttctgattacagatatccagattatcttccgccaacagtaagttgaagtaattcgtgatggtagcgatcgttacattctccacgttctccatataagcggccttagcctcttggtaacgaacaggctcgatacgacgtttccatttttggtcattcacgccgaagatcggttgcgtcaatgtcaaactaacaggtacgctcataaactcgttgtaagcgccactacctagctgacgggtaaaatccaaggaggtattcaaggcgatcttacctccggtcaaggctatgttctgggcgatagagatctctccatttaagcctaaggcattgttttgcacataggtataagaaccatccgattgctggtacttcgagtattgcttgctatatgaaggcagagtccccgtaaatatcacttccggcaactgatccgcccgatgcgtacggaattcccaataggccgttcgcaactcattgagcgccacggcagcgtctacggattgaagctgtgcgatctggatcgcttgccgcagggttattcgaactttattcgtattgtcttgggcacatactcccgaaatccccgcccacagacaacacatcgctatatagatccttctcatcttagtataagtttttttatcctgcctaaggcaaaaggcatgccaaaaacatatactattgataatccgacaaataggaatatttaaagtgttcgataatgaacagtgtgttcgtttttggatacttatctttgaatgagttgattattgacgatcgatttatatacctcttcccgtaaaggacgcgacaccggaattttatgctccccaatgattaatagatttccttctatcgcttgtacataagaaagattcacgatgaaagagcggtgcacttgcataaaaatttgtgccggcaacgtttccaatatactcttcaaccggagatgaacgatctctttggaagtgagggtatggataacaatatagttctccatgccctctataaattgaatctcctttaaataaagccttttaagttgcttctccgtcttgacaaagatataaacaggctcctcgcttttcgatgtagattccatcaacgcatgtgctttattgaccgatttcaggaaacgggaaaaagagattggtttcaataaatagtccaccacgtcaaactcatatcctctcaacgcataccgctcgtatgccgaggtgataattaccttaggagcgttctgagcactctccaaaaagtccagtccagacatatccggcatctctatatccagaaaaagcaaatccgcttgaaccgaattcagcatattattgagttgtatagcgtcctcacattctccgacgatggtcagaaaatcaattttaccgatgtgtcgccgaagtccttttctggcgattggctcatcatccgttatgatacactttatttccatattattctgataaatcaatacataactcaaccctaaaacgggtattgtctttttttatacgtagctcatgtttatccgggtacaatagctccaatcgttttctcagattgtcgatcccaatgcctttcccctttctttgttccaaggagtccggattgaaagtattgcttactccaaagcagacctttgacctctctttccgcatagatacttgtatccaatacgcttcgcccacatatttaaacgcattctccaataatggaaggaaaagcaacggatgtattttttgtccggtcaattccgggtcaaaggactcctcgaactgtaagcgtttcgtcatacgaagtcgctggaattgaatatatgttcgcaaataatcaatctcctcttcgatcgtcactttcgtatttatatcatataattgataacggagtaagtccgaaagtaactctacagcctcaatcgcttcctcattttcctcatcaatcaagaaatagatcgtattcaaggcattaaacaggaaatggggatggtattgcatcttcagcagcttcaattgcgtttccaattgatctactttcattttctccaattggacgattttctccgaatagcgtttggctaatatattattacggatcaagaaatagtataggagaaagatcggcacagctaccgcattgatcattaacgcctctccccaccgataggtcgttccatttatagaatagatcacgatatataagccgatattgagcacgactaaattaaacaagaccacccatagatattcccggaacaccgggcgggacctccgctctttattcctatctaaaaaagtattagccaagtaattaaaaaacaaataagataagctaacgccgatcaatataatagtaagggccttgatacgcccgatccacgcatccactcccagttcccacatgcgaacaccataagcgacatccgtaacaatccacaggcaacagatcgccaatatcgccattagcaacggacttagaaagttatattttatcttcatatctgatttcaagccataaatttattcttttactttgatctatgctcgtatcacgggcacttttttaatcaacgaagttatcgttccagataaaaaccaacaagtaatcttgacgaattgcggaatatgaaaggtgaatatcctgtttgttcgtcaggatatgcgataaaggcaaaaaatacctatatttgccctcctcaataagagatgctataaaaatgaagaatgacggtttcacatttcgaaagagagccagaagctttaaattcgctttcaacggaatcaagctattgatcacgaaggagcataacgcttggatccattgtttcgcggcagtttgtgtacttatagccggggtggtattcggactttcccgcatggaatggatcgcagtaacgatcgtgatcggagcggtattagctgccgaggcggtcaattcatccatcgaggccctagcagatttggtctcccctgagtataatgaggctatcaagcgaacgaaagacttggcggcgggagctgtattattgatggcgatagcggcagcgatcgtcgggtttatcatttttatacctaaaatagcaactatattttaaatctatgagacatatccttttcgcaattacaatgctcatgctgtgcctgtccgttaacggacaagaattgaaggtgaccggtagccggaaagccatacggacctcgggagacgtattggtgtttatcactccggtggcgagtttggcgacagtattggcaacccaagattggcaagggctgaaacaaggcgtattcaccggggttacgacattgggcgtaacctatgcgctgaaatacctagtgaagaaagagcggcccgacttcagcgataatcattcgttcccatccatgcatacctccgtatccttcgcgggagccgcttttatccaaaggcgttatggatggaaatggggtattccggcttatgcggtatctacctacgtgggttggagccgggtctatgggaagaagcatgattggtgggacgtggcggcgggagccgttatcggcgccggtagcgcctatatctttacccgcccgttcgcaaagaaacataacctgtctatcagcccggtagcgggagacgggcattatggggtatatgcgtcaatgacgttttaactcgcagatttttgccaagcacgaaaacagcccggccatgtatcactacaagaccgggctttcaattgtgtgtaagtgtatatgttaaacaaaaaagtcattcataccgtaaggcatccgcaggctccaaccggaccatttggtgagccggataccatatccccaagatgatcatcaccgccatgaccaagtaggttataaagaaacccgccacgaaacgggctatcgtataatccatatagaatcctttcgtcaattccgacacatgaagattaaaacagatcaataaggccgggatcgcgatcaatgtcaacaataataacccctcggcaatcatgatcccctttaagctgaaacgggtggaacccaaagcggtccgcaaacccatctcccctttccgttgttccgtgcggaaccagaacgtaccgatgatccccaagaatatattgaacagcaagaagcccatcacggcgatctggttctgcaactcggattttacgccgtttctcaattccatgctatatctcaagtccgagtatgggatgacatccagcaaatacaaacgatctatggagagttgcttctccatttgcttcacgaagaactccgggaaatcatgatccgcggaagggtttacccggacggcgatcttcacatggaaatcggtatcgtcctcggcgatctcctcatccgtcaaaggcatgaacagccagctacagcttttcgtgaaacggtcggcacggaaatcggcggtaaccccaccgatcgatcgcctatccccccagaaggaaatcccctcatcccgtttgccgcctttctcctgaaattccctaaacaggccggcggaaagaacaacctgacgcccgttcagcatctcttcccaatccttcttctcgccttccatgggacgaaaattaaacacctccagaaaaccgggtgtcacttccagtagcttcacgtactcaacatttatagaatcgttcacgtctacctgcatgtaccggttctctcccgtatgcggcatggacatcagccccacgcccaccgcctctacgcccgggcaggtcttgatacggtcgatcgccgtcagcatgctgcgtccggaagtgacgtatcgataggtagaatccatctcgttccggtctacctcctccacacccatcgaaatccaatagacatggtcgatatcccatcccatcggggcgaagaagactttcccaaccgccattagcgaatcgattatgtaccacagaaccacgaataccaacaggatctcggcggcaatccacccattgcgcctacgttggttccagatgatctttactagatgctttatcatttcagtgacgaattatagaattaacaaaaccggttattacttatcattcaatgaatccactatattcccattagaggcattccacgccgggatcgccgcactcagcagattcagcaataaacagaacaggaaagcaaagaagaatatagccggacggatcaacatccccgcgctcaacgtcaggccgctattcaaggaagccagctcgaacgagcctaacagccaatccttaagcaagaagatcgccacataggagaacagcaatcccaacaccccgcccaataacgtcacggcgagattctccgccagtacctgccgtatcaacgtgccacggttcgcgccaaacgctttccgtacccccagctcccccatgcgtttctgcatccttgacgcagtaagcccgctgaggttcatagccgggaccagaagcaagacgatcaagaccaacgcatactgccccaacattctcggcacgtcgggtacgacattactccacaagcgaaggcggctctccatctgcgtatccggctgcttcatcaagtcaatcttgagttcttgcaaggaattattaaaccgggctacgttttgctccacctcggtcttgatcttgtcgaagtcaccgcttgagcgagccaatatcaagaccctataactaccgatcagcccctccaatgtctcctcgtttatcagccgatccacatcggattgagcatagggaatccagatctgggcatacgcatggttggcgaggggagatacgtcctccacaataccgccaaccacgtacggacggcgtgccaccaatatcgtttgccctatcacgctctcatcggccaatccaaacatacggaacgacaaaccacggctgatcaccgctttcttgatattactctccacatcgctccgcaggaatggttttcccgccaagaactcgaaatcgaagatcttccagaagccctcgtcggtccgtatctgatcgcatttcatccgtctcgtttgatccgtggaagtgaccagcgtttgcatccgcatcaattgcatgctgacggcctccggggttttcagcgtaaagaagcactccttagccacacggccaccgacaagggaatagttcataccgccatcctcctcattcttatgcgtgatcgccacgtccttcacataaagcgtccgatcccggttcaactccggcttgaagcctttattttgtatctcgaagacaatgaccatcaccatgatcatgcagatcgccaaggccgtgcccagaatagtaatcacactgaagaaagggctttctttcagcatctgtagagcttgtctaaaatattgcctatacataaagtgttcgtttttatgactgttatctatctattagcaaatgctgtgccaaagacgtaaacaactgtatatcaacagacatatcataaaaaagtgtccgataacgaacatctggctcgttatcggacactcccgaaagcaggctacgctaccctgatcactcgtaatgcagagcctccgccggctccaagcgagctgtcgagcgggcgggataccatacgccacagatgatcatgaggacgatcaagacaaacgtaatccctccgcaaatcgcgaagcgcagccacgtgaacggaagctgataggtatctatcaaatccatatgggcgatgttgaagctgatgactaaggacgggataaacgccaagaccagcaataggacaccctctcccaccatgatcgagttcaactgacggcgggtagagcctaaggccatcctaagccccatctcgcctttgcgatattccgtacggaaccagaaggtaccgatgatgccgaggaatatattcgccaataggaagcaggctaccgccacacgggttttcacctcgttctctacgccgatcgaacggatataaccgttgcgaatatatgacaagggctgtacgtctagcagatagaggttgcctagccgaagctgttcggccatatccttgcggaagcgtgcggggaaatcagcattatcgacatccggacggacacgtacgcagagtcgcacggcatctatcatcccctcatagtatccttcctccatccggcttagccgcagggccctatagacgttgggttccgccttggtgtactcatgacggcggatggggacgctgataccacggatcgtctcctcgatctcgtcggtcacattcccccggtacgccttttgcccgagtagggaaaggccggaattcatcgtctccacgtcggcggagattacgatggagttgttatcctcgatggcccgtttcaaggaagccgtcttgccgtccttatcatagatacggaacacgtcgaagaactccggggtgacgaaagcatagcggcagggcacctgcaatgtatcaatccgccaaacgaggttacggcttcccatataataaggcatccccccatccgtaaggcaagccgattccacgccgggataggtgcggatacgatccaacgccgtcagcagatgaacaccatccggccgctcccgcttctccttcgggatataatccgggcttctttccgaaaggctgctgatcacgatgctgtacgtatgccggatatcgaagcccagaggagccgtatacgtgcgccccatcacatacaggtagtccacaaggaaccaaaggaagaccgagaccagcaataactcagcccacaaccaagcgttttgcttgcgctggttccagatcaattgtaataaatgtcgtatcatatctttctattattttagtatagctatcatccaacgcgggagattaatgaacattctcgttgagagccgagatgatacgcatccttgaggctcgccaagccgggatgccggcgctcagcaggttcaacgcaagacaagcaaggaacgcgtaaaggaagatcaatggattgaacatcatctccgcattgacgaaggtgcgaccgatacccatcgatgccgtgcccgtatccagcaaccaatcggacaagagcagtacggaggcgtatgagaaaaacaaacctaacacacctcccagcaaggtctgcaacagattctcgtagagtacctgcgtcagtaattccgagcgtgtcgccccgaacgccttcctcaccccgatctccgccatacgtttacgcatccggctttgcgtgataccgctcatgttgatggcagggatcagcaaaaggacaagaacgatgataacatatttcatgaccagttcccgtacatttggctcagagaaagcgtcctcgcgagccaaatcgcccaaatgggtatcgggtcctcctccaattttcagcaggtgcgtgctttgtgattcgttaaggcgagcgatattcgcctcggcctcggagtggatcgcgtcaaaatcggcggacgaactagcgaggatataacaacggaagcccccgatgagacggtcggaactatcatcatacagggaattgtcggtggtataaggcaaccagacatcgccataggcagactcggccagcagggagacatcccgcacgacggcacggatggtatagggcacgtagctgatctcgacggtacggcctacaacctcggtcgtgccatacaaccggcgtgccacggactcgcttaccacagcatccatgatgccactttgtacttcttcctcgccataaggcttaccggagaggaagcgaaagttgaagatattccaaaacgccgcgtccgtaaaggtcacgtcgcacttgaactccaccgtatgatccgccactgccgccaagcgttgcacgccatgataggccatgccgaccttctcggcagagcgcaagggatagaaacaatctttcactacccgggaagcgagaaggtagcaatcgttataagattcgttctctttgtaggaggcacgggtatcactgacgtacatcatccggtcccgatagtcttccggagcgtaattggcggtacgcatctgccatacgatcacgatcaccatgatcatgcaaatcgccaaggccgtaccgaagatagagactccggaaaggagcttgttctctttcaataaggcccaggcttgttttagatagatcttgtacatattcatttgatttaattatacgattcagtcggtgggagacggggcattatatgttatccgtcataccgcagcgcctcggccggctccatctcggcggccttgctggcggggagccagacggcgagcaggatgacgacagccagcagtatccatgtcaggatattcaccagcaagaaacggagcggcaggatcgccggccagtaatgctccggcaaggtccctttggggatgtccaagaagccgaccatcacgaattgagcctctatcaacaaggcgagcggggtagccatgagtaacaggcatatgccctcacgagccatctggctacgtatctcttcgcggggcgaaccgatcgccatgcgcaacccgatctctcctcggcgcatccgcacccggtaccagaacgtacccatcacgcaaagcaggatattcagtcccaagaaggccatcaacgccatacggacccggtaatcgtaggtaacgccaaaggaataatcggtatcggccttgatccggtcataggaagtcaggcgtttcaggtagaagttccccacccgaagctcacggttcatcttctcccggaacgtatcggcgaaacgaggaccagccacggcaggatcgatccgtatgaaataattcatctcggggatctcctccaccgagggacggatcgcgaagaatgcggcaccttggggtaggctattgtcaaaacgcttgatatcctctaatacgccctttacgatataagtcgggccctcctcgtcgaaagggtctttcacctcacgcccaacggcggatgcctctccaaatacctttcgctccaccatccgggtggttactatagcgcgggggtctccccaatcaaaatcggatgtagataccggacggccgtctttggcgtacgaatggttgaagaccgacaggaaatccgtggtaggatccatctcatacctcatgaccgcttcccgcttgctcgtatcggccgcgttcgccaaaccgataccgtaataacagcccgtataaggcatggagtaacagcccgaggccgcgcccatcgccttcacccccggataatcgcgcaggcggtcttttatccgctcataattttccagcatggcgatcgagtcactctcggcggctcgatagtcgggggaggtttccggcaagaggcccatttctacctgccagacattcgcatagtcacgtccggaggggagactacggttatagatctccacgaagaagtaatccaccatgtaccacgccagacaaaaggcgagcagcaactccacgcacacccacacgttgctacgccagcggttcatcaattgtatccaagtcattttccacatatctttcttccctccatttaagcgttcaacgaatcaacgataggtcgccttgacgcacgccaagcgggccacaacgccgacatcaggtttaacaggaaacatacgcacaaagcgatcaagaagacccacgggtttaacagcatccccatggaaagcgatacgtccacgccatccggggcggcctccgaaaaccccttgccgatcttgaagacccacgaactggcgaacgtcaccagcaggaaggagaacagcagtcccaccaagccgcccagcagcgtatacaggaagttctctatcaagacctgtccgatcaacgatcccttgggcgccccgaaagcacgccgcacgcccagctcgcccagacgccgttccatgcgggaatcggccatgcccgagaggctgacggcggggacgagcagcaggagcaggaaaatcaccccataacggctcaagtctcccacgatatccggctccacgttcgaccaataccggaagatactctcccaatggcgatccggctgcccaagaagggagaactcacgtttgccatccacgtccaacgattggttgaagcgacgcacgttatccgccaccgcctcccgcaccttgccgatgtccgccttatccttcacgagcatatagaccctcaagggccccagcccgggcatatgcgcctccgagtatcggacccgctcctcgaagtcgggcgcttgggtatacggataccagacctgcgagaaaacccgatccatcaggaaagatacatcgtccaccacgcccaccacacgaaatgaggtaaagtcgaggctcaaggtctgccccacggcactaccttctccataaagccgcttggccagtgagcgggcgattaccgccacgggcatccccgaccggaaatcggcctcggtgaaaggcttaccctccaagaaacggaaggagaatactttccagaacccatcgttcacccccatcttcatgaccggtacctgcacgggactgcccaccggctgcacgaaagcggaagtggcatcatcataacgtaacgccaacgcctccaaaccgggtacgcccgcaaggcactcttccacgaagcggggcgataccgggctactgctcgttccccctttctcattcttcagcgtggcgctcttcacggtcagcaaccggtcccggtccatctccggataaatagaggccattttcacgtaaaacacgatggacaacaccatcaccagcgagatcgccaatcccgtccccacgatatagaccgagctgaacagccgttcttgccggatcagggcccatgcttgttttaagtagatcttgtacatattcattcgatttaaatattctatcagtcggtgggagacggggcacgccccgtctctacaaccgggtgttacctgttttctattatccgtcataccgtaatgcgtcagccggttcctgccgggccgccttacgggccgggtaccagatagccaagaagacgacgaacgccaagacaccccctgtcagcaggctaatggccgtgaagcggatcacgccgcagggcacgatatcggccatcgccagattcaggcagatcagcaagcccggcacggaagcgatcgccagcagcaacaagccctcgccgatcatcagcccctctatacccttgcgggtggagcccatcgccatacgtagccccaactccgaacggcgacggctcacgtgaaaccagaacgtaccgatcaccgccagaaacacgttcaccaagaagaacaatcccatggccgataccagccgatgggcgcttgtccgctccgagttctcgagataaaaggcccgtatcccttcgtagtctctcacttccgatacccagtaattacccaccatcaaggatctactcatttccttccggaacttggcggcgtagttggaggtagagacctccggacgggtgcggaacgtgatctgcactcgcatgagtcccttctcgtccaactggcccttgccgaacatcccccgcaagtccagtggagagaagacactatgctgattccgggaatcgtactcggagtttcgtaccggctccgtaaccgctatcacgtgacagggcagggtatcgttgtaattatagatctcggccccgatcacgtcggtatggccgtatagcttgctcgccagatcggcggagaggatcatctcccgcccctcccgaagccccgacagggtctgccccagtctctccgggctttctcccgtagcggagcggatgccgaacacccggaaataccccggcgagacggtcattgcccgcacccgctggttgatcgagtctttcaagactctgctgccgatgttcgagtcggtataaggcagcgaatagtacgagagccctaccacctccacgtcgggatgccgctcgatacgctccacgatacgctcgatattccgcaccggctcctcgcttccctcctcgtaggcgatgaacgagggactgtcggacggccgtatggcgagcgtcacgttgtacacgtgatccagcttgaagcccaccggcatccgcgtcagcatcccttgcgccacgaagtagtacatcatgaaccacaggatcacgaatacgaccagcagttccaccagtatccagcagcttcctcccaaacgggaccttatcaactttaatagatgtgttaccatagccgtatcctatttatcgttcaacgcgtccgttatactcacccgcacggtacgccaagcgggtatcatcgaagagagcaggttcagcgccacgcagacagcgaacgcgtaggcgaacacctccatattcagcagcatccccggcgagaggaagatatcgttacccgccccggagcccatgctatgcaaaccgggggaaagaaggatgccccggaatacggacaccagcacgtacgagaacagcaatcccgccatgcccccgggcaacatcagcagcatgttctcccagaagacctgccccatcaacgtcttccgcgacgccccgaaggccttgcgtacgcctagctcagacacccggtcttgcatcctcgaggcgttcaggcccgagaggttcagcgccgggactagcaggaagaggaagagggcgacgcccaagacgatatacgtctccggcccgaacaaccgcgacaataaccggtcgccgaacgagcagggcggctccactctcacctgtccctcccgcaagccgctgttgtagcgtcttactcccttctccaactcggcggagagggccggaaggtccgaggcgtcacgcagcaggcagttggcgagcagcagtcccgccgagccttcccgctcctccaaggcggtatccatgatactcgccatcgaggtgtagggtacccacgcctcggcgtaaacgtcggaagcgacggcggatatatcctccaccacgccgcttaccgtatattctatatcgttgatcaagacggtctgaccggctacctcggtacgcccgagcaggcggcgtgccaaggaacggtcgagcaccacgcggggcatcccggaaaggaactcggcactggcgaacggcttcccgtccaagaagctgaaacggtagacttgccagaacgcgtcgtcgcatcccatcaattgtactttcggcgactcgtcgctacccggcgcttggatgaagatgtcccccacctcataaggcatgatggcggcgttggtggtgaccgccactttctcgggtgtctcgaggccgtagaggacctccttcacgaaccggggcccgcaaccgctgttcaacgagcctttgcccccgttgaactcatacgatacgttcgatacgtagcccatccggtccctgctcacctccggggcgatattcgccgtccggatatggtagaccaccgctatggccatcaccatcgagatcgccaagcccgtaccgatgatataaacggcggtgaagaagcgattctgccccatcaaggcccaagcttgtttaaggtataccttgtacatcgttcattatttgttagttcgttttatgggtatctgccacctgctttccgtaattattatacgcttggcatgtatttccaaatactattcatgttatctttcttatctttgccactcaatcattcattaaaccacgagatcatggataaagaaatacctaagtcggagctgcccaagccgtttcgcaagctgagcatccgcgtcagcaagagccacctgcccggtaacgcgagctataagggaagcgtcgtatggcaacgtacgctcagcatcgatgacatcgccgcccgtgtcgtagacaaacggagcgagtatcgcaaggagacgctcatcaccaccttcaacctcctcaagcgggagatctacgacgccatcgaggagggctacaacgtggacttcggcttcgggcggacggaactgaccgtgaacgggcctttcgagaccctatacgagaagttcgaccccgaccgccatacactcgccccacgcctgcgccccgcaccgcaactgaagcagcgggtgggcaacctccgggccgtgaacgagacctaccagctagcttacaactcaatgccccgccccacctacgtcagcctccgcatccagccccgcacgtccgacagcgacgagccttacaaccaactccccgcaggcgagcatcccttcatctccatctatggcgataggctgaagctagcgggcgactctcccgaggtgggccttacgctacgctccgtcgagaccggcgacgagcatttctaccccgccgccgatatgctcgtcaacagcgggcagcggctctgcttcgtccccggcttcgctttcggggcaggcgagtgggaagccatcgtctgcacccagttcaccccgacttatcacctttataaagagcctcggtatggtacgctgaccttcaccgtgatatgaggtatcgaggcactacgggtgataccttgcctcatacgtttgaggtatcatacctcatagctttgaggtgtcatgcctcataggtttgacgtatcgtacctcatagctatgaggcaagatgtcacccgtggtgcctcacacatggagatcccccctatgcggctcccttactgcacctgccttccatcgaagaagcgcacggtgcggctggtttgcttggcctgcgcctcgttgtgggttaccattacgatggtgcggccgtcctccttgttgagttggtggagcaggtccatgacctcgatacccatcttggagtccaagttaccggtcggctcatcggcgaggatgatgtcgggattacctacgatcgcacgggcgatggccacgcgctggcattgaccgccggagagctgcgtcgggaaatggcgcatacggtggctgaggccgaccttctccagcacggcctcggccagcttgcggcgctccgaggaggataccttgcgatagagcaagggaagctccacgttgtccagcacgttcagggaattgatcaagtgaaagctctggaacacgaaacccagttgcttgttacggaaagcggccaactccttgtcgctcatgcccaccgtgttcacgccgttgatctcgaccgtaccggaggtaggcaagtccagcaggcccatgatgttcaataaggtggatttcccgcatccggagggtcccataatgctgagaaactcgccttgctgtacctctaggttcacgttttccaacgcgactgtctctatctctttcgtacggtaaatcttctgtaaattcgttagtttgatcatgactgtaatattttaattgttattgtttgactcttgttattgttaaactcttgctatcgctaggctttgccacctaaaagcaaattacgtgccagaaacgtatctcattgattccatgacatctccataaaaaagtactgtccgttatcgaacagtcgattcatttccgaacagtcggttcgtttccggacacggatgcccgtgccatccgtgccgtccgtgtccgatcattcctgccgcaaggcgtccgccggatgcatccgcatggcccggtaagacgggaaactaattcccacgacaatcatcgcggccatcaccgcatacgagaagacgaagccgaacaacaggcgtgaggccatgtcgggcggtatctccgagccttgcgtcacctccatatacagcaggttggcgaagatggcggcggaggggatgaaagcgatggtgagtagcgccaagccctccttcaccaattgccagaatatgcccttgcgggtggctcccatcgccatgcggaggccgatctcggcgctcctttgttgcgtgcggtaccagaaggttcccaccacgccgagcaggacattcagcaggaagaaggcgatgcccgccacgtaaaggcggacttgatccaaccaacgctcaaggaactggtcccggtaatgggacatcgggaaaacatccttcaaatagatattacccatgcgcaattgctgctccatctccttccggaaatcggcggcgaaagcggcgccgtccgcgccgggcttcacccggatgaaggtgttcaagccctctccgacccaatcgccctcctcggccaccttgttctcgtccaccagcttatagtaagcgtaatcatagccggtgaactcgcagtaacgttgtttctcgcagacaccaccgatacggtaggccacgctatcacgagagccttggtcggtgatatagatctcttggcgcacggccgccgcaagatcgccgaagaagctgtcggcgaccgtacccgtcaccaccacttggttgtcacgcagggcgtccaccaactccgagggggacccgccttgtgccgtctttacgtcgaacacctcgaaataggtgggcgatacgtaacgcacgaagccattacggatcaacgagtccttccggaacgtggcgtattggttcgatccccggtaatggaaatgcacgccggtggtgaaacagattgattccacggaggggttccggcggatgcgatccatcaaggtcagataatccccgcctccccgttcgctatgcacggaggtcgtgtcatagtcgggactttcctccgggatcacgccgaagctcacgtgatacgtatgttcgatattgaaacctaatgatcgcgagtagagtttatacatcacgaacaaggcgtccgccgcataccaaaggaagatagagaccacgagcatttccaaccagataaacaagttccccttgcgctcgttccagagttgttttagaatcatcttatacatagcgtcaaccatttatagagtccgtaatattcaatcttgacattcgccaagccgggaggccggcggaaaacaggttcagcacgaggcagaacaggaaggcggcgataaagaccgccccgttaaacatcccggtggaaagccccgtcttccccagcgaggtgaccagcaaccagtccctcagcaacaacatggcgccgtacgacatcgccaatcccagcagcccgccgagcagggtcaagaccatgttctcggacagcacttgccagaggatggtgccttgcgtggccccgaaagcccggcgtacgccaagctcggccatccggcggcgcatcctcgacagggtgatgcccgataggttcaaggccggaaccagcaggaggatgaaaaggatgatgccgtaacggacgtagaggtagaagaggttcgccccgaactcgctaccgccgccgatccattcctcgatctgggtggagggctggtgaaggatatcagccttgacatcccgggtcttggcgttgaactcctcgaccttccgcagcgcctcggtcctcaactcctccctcgtgacgcccggtttcagcaggacgcaacagctatacgagccgttgatgccctcttggtatcccccgtcgtcccgcaccgtgtaagggatccagacctccgcccacgctttcgaggcgaaccgggatacgtccttcacgaccccgcagatattgtagacgatgaaatcgagcttcatctcccgccccacgacttggtccgtgccgaaaagggccaaggccacgctctcgctgatcacggcgtcgcggataccgcttgtgaaagccgccgggctgaaggggcctccttgcaggaaatcgaactggaagatcttccagaaggcggtatccgtataagagatgtaactcgtccggttcttaagcccgtccatggacgaggcggtcaacggcctgtagcgatccatattgatggcggtaacagcctccgcccctttcagcggatagcagcattccttcaccaagggcagtcccaacgacgagtaggagatgcgccggttatcatccttgccattgctcatgacggtcgttatgtagcaggtgcggccacggtttacctccggcttgaaactcgccgtattcacgacatacaggatgacgatcaccatgatcatgcaaatggccaaggcggtaccgagtatcgagatcacgctcaacagcttgttctccccgatcatcctcaacgcttgtttaatgtattgctttatcataaacctttgtattataaattatctattacccgactaaaacagtgattgtttgttatcgtccgactttgtgcccctacggaggcaaataacgtgccaaaaacgtaaccgcctgattcctaacatcaccccgtaaaaaaagctgtccgataacgaacacttgattcgttatcggacagcgattatggacagtttcagattttataattcccaacgtaaggatctcagcagttcatcgatctcggctgccgaaatggagtcacggtcggccttatcgtagatcgtgaggagaacaaccgtaccctcattatctgcgcagacaatggcctccgtgtaagtaatcactctcgccccatggctctttccttttcccttggaggcgatggccatgcgtaccttgcgaacgcctttgcctaagctcgtcccttgatcggggttctcgctcaaagacttacccaaagccgataaatcagccttcaatgagctatacttcttacagagacgtttgaactctttatcgaagtcttgatgggtttttatcctatacctcattgagcaactcacttaagtctctaaacttatgccccacatccttgccctcacgcaaatccttcacgtcttgcagggcattccttagccccgccaagatctcctccttggtaggctctgcgtaatcgtctgccggcttctctaccggggtggcctttccaaaggcagccatcttcatacggcggacgctgtcgagggcctttttgatcaactgttcatcctccaaagacatcacctcttgcagtaacgacatttttaattctatagctgtcataagcttgctcctttctcattaataaattgacagacgcaaagatagacaatttattcgtaatgcaacgcctccgccggagccatctttaccgccttgcggacagggaaccagattcccatgcagatcatgccggccatcaggaggtaggagacgctgagggttactagaaagcggaggatggagaggggctcgcggtaggaatccagcttatccaaaaaggccatattgaagacgaagaccagtaggatcggaacagtgatcgccaagaggcccagaccttccagatacatgtactcgcccagcctgccccggctggaaccgatcgccatgcggagaccgatctcgctacgccgccgctcggtacgcaaccagaacgtgcctacgataccgaagaatacgttcacgagcaggaaggccatcatggagagtttcttgctgttctcgttcttggtaaaccggagttggtcatcacgctggtcggcaaggagggtgacaccgtggacgaaggtgttatttaccgtcatccgatccgctgttttctccaagaaagcgtacatctcatcctcggtcatcgggcgtttcgtacgtaccgatagctcagcgctccttacgccgaaattcttcacgaactcccgcaaggactcacctttcaatatcgtgaaagcgcagttctccggacggtcgaagtcattgctacggaaggtaggaaggacagcggcgatcgtgaaaggctcggaaaggtcgtcattctccgagatctgccggcctatggcggactgccccccgaagaagaaatcctccgcctccgccgttacgacgagcggacggtaagcgttctccaccagcggggtgatggcacggccctccttatccttcatacggaatacatcgaaataagaaggagatactttcagcttgtggtagttctgtcctaccgccttcgaggtatcagcgcccaagggaaggagcgtaccccacgaacttccgtttgaataaggcatggaccaatacgtaacacatacctcctcgatctcctgctcttggcggatacgttccataagcttcaacaaatcctgtgtcgcgttcgagtcgtaaagtgagtcgggcacataacccggggcgttcgacgagagtgtggaaagcttgaaacgccacgtattcgagatatcatatcccatcggggcgttatagcagcgcacatccacccataacttatccatcataaaccaaagggcgcacatcacgataaccaactcgcccaatatccagccgttgctcctgcgctgggcccatattatcttaaatatatgcttaaccataataattgacagttgatagttgatagttgacagcagacaactcattattcattgttcattattcattataaattcactcattcccctttaacgcttctacgatcggttgccgtgtcgtacgccatgccggtatcccggcgcttaatatattcagcaagaacgtaaagataagggcggagataaataagcccggtttaataagcataggcgccgtaaggctcacgttctcgcttaacatgaaaggcttccctaccaccagcaacaccatcgagagaccgataccgatcacgccaccgatcaaggtcagcacaaagttctccgataagatctgcatcaaaagattctgccccgtagccccgaaagccttacgtaaaccgatctcttctttccgcttctgcacagacgattggatcacgcccgttaagttcagcgccggtaccaagagcaagaagaataggaaagcgcccgatccggccaagaaggtaggccagtccaccttttgaaaagcgccgcttcccatggccgtatccaactgggaaagtagcccggaagggaaacctacgttataatcggtcttgctgtcattgtagcgacggacctgttggtctagctccgagcgtatggcatcgaagtcggaagaggaacgagccaataaggccacgctgaaataaccggccatattctccccatactccccatttacacgggtcagggcctcattgctgctatagggtatccatacctgagcgtaggaactcatcaatgaggaaggtacgtcacgcaccacaccgcagacggtgaaagtgataaaatccatcacgacctgccgcccgacggcctgtcccgttccgaacaaatcggtcgctacttgttccgacagcaccatcttcggtataccggattgaaaatcagcctcgctaaaggggcctccttccacgaaaggatggtcgaatattttccaatggcccgcatccgtataacaaatctcatactccttgaaaagccgtctattgggcaatgacaaggaatggctatcactacaatagccggatacggcctctggtttccgcaaggtatagaaacattccttcacgacctcgctggacatgcctccacgattacgatccgattctccgggggatttcgaaccgacctccgtaccccagacatacataaacctagaccgattggactcaggggcatatcccgtggatttaatctggaacaccaataccatcaccaacaccatggcgatcgcaagggccgttcccgaaatagagattacgcttacgagcgtattttcacgcagcatttgaaccgcttgtttgatgtactgcttatacataattcgaatcgttatttcaatttcagtttattcttttccttgaagcttgtcatatcggaaacgaccacctcgtcacccggttccaagccattgactacttctacatactcaaagttgctgtctcccagctgtaccttccgcttgatcaattggtctccgttgacaacaaacaactcatactctcctttcccgacgtagaacgaggcgttggaaatacgcagcacatcgtccttgatggcattcatcacgtatacatcggtcttcaaaccggagcgcaagcggcgatgattatcctcctccaactgtaccgtgaaagagattacaccgttcttcgataagggggtaacatcgctaaccaccccatccagtttatcgttgccgatctttacaacggctttgctaccggcggcgatccggtcaccataggtatcggcgatctccccctctatcttgaaatgggacaagtcggagacgatagcgacacgactgccttgagagacttgggcacctacctcgttgttcacgtaggtcaggatcgccttgcggggagagcgtatctgggcgtcttccaaggtacgcttcgtctcggctaggctctttcggaagatgttcaggtcgagttctttcactttataatcggcatccgtcaaggatttctcgttctcatatttttgctcatcctctttcagtttcaagacgctaacgttatagtccagttccacttgacggaccttatcggtcgttccggcgcctaggctatccagataacgctcgttgcgcaactccacttcctttcggttcagttccatgcgagagactttcaattgcatctccatctcggaaagcttattgcggttttggatacggagttgatccaattggaggcgtttcatttgctcctcgtccaattgtttcttataatccgtctcggcgctgagcaagtccagtttcaagatcggagtacctacatccacggaatcgcctccctttttataaatctcgacgatacgggagttgatcggtgagttgatgatttcctcgaaagcaggaaccaccttgcctgacgcgctaacggaaacctcgatcactcctttatctaccgttgaaaaaaccaagtccttccgttgcaggctggtttgcataaaaccgatcaccccgccaatcaagacaacggcaataccaatccccgcccccagctttataaactgtttacgctgctccttctgccgaacctcttttgatatctctctgtccatatttcgtttgtttttattttccaccctccaaagagcaaaccccgtgccaaaaacgtaagtaactgattctatgagaatatccatttttagtactgttcgatttcggacactgtgttcggtttcgctcaaaacttttccgataggcctgttgttttatgcccaaaacttataaacgcaaaatgtatgaacacaagacttatcctattcacatgtatagccggtctgactctctttttctctggctgtagcaaaaatgatgatgatcatcaaggtattatccctctccccccggtagagaacgctttccaagagaaatatcccgatgccaagaaccctgtttttgagatcgaaggtaactattatgtggtagatttcaataatgaaggttccgagacaaccgcttggttcacggatcaaggcgtatggatgatggaaaagatagacatctctttcgcccaattaccagcagcggtatccaccgccttcaaacaaggcttttactcaaattggaccgtggatgacacgtacgccatcaatcgcctaaatatgggaatcgtttacaagatcgaggcggagcagtccaatagcgaagtagacctgtattattcacagtatggaaacctgatcaaagccgtggacgatgagatcaataatgacgcaccgatcgttatcccgaaagaggtcagcaacctgatggagatcactttcgccaacgccgagttgctggatatccaacagaacagcctaggttacgagctggatatgatcgataaccagatttataaagtggcgcaattgaataaggattacaggtggcaaagtaccacatgggccatgtccgagcaagaggttccgcagatcgtgatgcaaggcttcgaatcctccgcttacgccagcgacaaggtacagtccatatatacgttattgaatgccaatggtaccttctacctattcaaggtttcacataacgggcaggacgagacgattacctttgatgtattcgggaatatcgtataaaaaagccgcgcgattcacagccgtctccggacttgaatcgcgcggtttgcgttatatgataatcaagcttatttactgatcaattccaaggtcgccccttttactcccggcgcggaagcctcgaaatagatcgttcccggttcctcggccgtctgcacgatagcggtaagttgcccgctaaacagtttcatttccggaagatggaagagttccagactggcgctatttccatttgccgccgcacggtaggctccggcaccacgaaccttaaactggatctgtcgggtatcatccggacaaaggttcccgttcttgtctacgactctaacattgatgaaagaaaggtcttttccgtcagccgtcaattggttacgatcggcggataactcaatatgatgcggcttccctgcggtatgaacctcctcctcggccacagcgttaccctccttgtcataagcgaccaccttcaaagttcccggctcgtatttggtatccatccacatcaaacgatatcgtttctggcgctcgaaactcttttgagccgcttcggtataactactatcgataccgatgcttagatctttcgtacgtttcccttggctctttccgttgataaacaattcggcggaaggataattggtataaacgaatacgggtgtcacctcgccctcacgtcccggccatgtccaatgcggcaggatatgcaatgtcttggcgcttttgttccaatgactacggtatagatagtaacgatccttggggatacccgccaaatcgataataccgaacaaggagctatggcttggccaattcgtataataaggagtaggctcgcccagataatcaaatcctgtccatacgaattccccgatacaatacggaaggtcctcatgctggataaaatcgtcttccggcagattagaccagttgcaatgctccacgtcgtacgaggaactttggtgatcctcatagacagccatcgccttacgctctaccgggaatttataaacccctcgtgagctaactgtggaggccgtctcgcttcccaagattatttgctgaggcagtttcttataattcacttgataacggaacggacgataattgaatccagccacatccatcaccgccgccatattattattcacgacggcatccggggcatccataccttgcgtcaccggacgagtcgggtcttcccgatggcagatatcctgcaagaacctagagatcttacaaccgctctcatcccattggttaggcacctcgttaccgacgcaccacatcacgacgctcgggttattccggtaatgatgtaccaaattcacgaggtctttctccacccattcgtcgaaaatcaaattatagccgttcgcgcatttcgccttgttccattcgtcgaagctctctgccatcaacatcatacccatctcatcgcaagcctttaccaactcgggagccggcatattatgggaagtacggatagcgttgcatcccatgtccttcaagatccggatctgacgacggatagcggcatcattgacggcagcccctaacgggcctaagtcatggtgattacaaacgcctttgaataccgtcttctcaccattcaagaaaaagcctttattcggaatgatctcgatcgaacggataccgaatggggtcgtatagagatctttcagttgatcgccctcatataaacgagtctccgcagaatacaaggcaggcatatccggcgaccataaagtcggggtctggatgataaactcttgggagaggctattatcattgtacttaatctgtgagagaggcgtagtctgctccgtcaacttctgcccgttcggattccacacactggttttcacgctatacttgctggcatcggccccttccggcagtacgattttcgtctgtacattgactttcgcaaattccttcgtggcggtcggggtcgtaatataagttccccagaccgggatataggcgttttccgtcacgattacatgtacattcctatataatcccgctcccggataccaacgggaggattccggcaagttctcaaggcgaaccgccaaggtgttctttttccccgggatgagctgtttcgtgatatcgaaatagaaagaattatagccatacggccaatatccaacctcttgcccgttcacgtagaccttggcatggctcatcgcaccgtcgaacaggatcgtggcacgcttcccatccgtaaattgaggaacctcaaactcggtccggtaccagccgactcccacgaaaggcaaacctccggttcggccggcatgttccatggcctccgtttgtccgtcttgggcgatagcgacctcttgcttatcattctgagagctgaaagggccgtaaatcgcccaatcatgcggaacggtcacggattgccacttactatcattgaaagtaggattgataaactccgggcggtcttcccgggcgaacttccaattcttttccaacaggaactcactgcgtacttgcgagaaaagcgcagggaaaaggcaaaacaaaccgatcaaaatagcgaaacttgttcttttcattcgttttttgtgtttttgttattcatagcggaacaaaaataagtatttttgtctccaatacaaactaaatcaaaagaattgcacagcatgttgttacaattagctttcgttttaatagccattattataggtgcccgtatcggtggtatcggattaggcgtgttaggaggtctcggactcggtatactcacctttggattcgggctccagcccacttcccctcctatcgatgtcatgcttatgatcgttgccgtaatagcggcagctagttgtatgcaagccgctggcggacttgatctgatggttaagtgggcggagaaattgcttcgcaagaatcctcaacgaatcacgatattaagcccgttcgtcacctatttgtttaccttcatagccggaacggggcatgtggcttattcggtccttccggtaatcgccgaggtcgctacggaaacgaagatccgtcccgaacgtccgatggcgatcgccgtgatcgcttcccagcaggctattacggccagtccgatatcggcggctacggtagccatgcttagtatgttatccggatatcatatttccttgatgaatatccttatgatatcagttccttgtaccttattgggggtattggcgggagcgatctattctttaagggttggtaaagaattggatcaagatccggaatacttaaagcgggtagcgaaccatgagttcagcacgaagcattacgaggcgaaaggcgttgaaaaccaaatgaaagcggccttatcggtctctatatttgttctcgctacgatagcgatcgttatctttggttctatggagtccctacgtccggtctttaccgtcggcacggaaaaggtctcgatgcagatgtcacatattattgaggtattaatgttgacagcctccgctttcatcttattatttacaaaaacagatggtatcaaggccgcacagggttccgttttttccgcaggcatgcaagcggtggtagcgatcttcggtatcgcttggatgggagatacatttatcgccggcaatatgactgaattaaagggatctatcgagcatatagttacacagatgccttggttattcggattggcccttttcgtaatgtccattttattatttagccaagcggctaccattcgtgcgttattgccgctagggatcgcattgggaatctcaccctatatgttgatcgctttattccccgccgtaaacggttatttcttcatcccaaactacccgacagtcgtagccgccatcaacttcgatcgtacaggcacgacccgcatcggtaaatacatcttgaaccattctttcatgataccgggattgatagcgaccggggtttctgtaggattggggttactattcattcaattcatataataagaaagcaaaaatagagacgcagcatacacgctacgtctctacaccccacaccatatatcatattatattacttcaacaatttttcctgaatcaactgctttaactccagttttcccatcgtgccgatcatcatctcacgggggccgtctagcgggcaaaacatcaaagtgggaatcgttcggatattaaaggctgtctcgagtgcctcctcttgatctacatccaccttataaatataaatcttcccatcaaattctttggcaaactcatccaatatagggcttaagcgtttgcaataaccgcaccaaggagcgtgaaaatctatgaggcaaggacgacttcctatatatttccaatctttgggattcgcctcaaaatcaccgacattggcgataaaaccatctttcgttaaatcgatcactaccatacttctctatattttgatttataatataacaaagataagtatgaataggttgcggtattttttatactttcgcggcatcgttttaacaacagacagaatgctcacacttgataaaatttatcaggcatcatatgccttgaagacagtcatcagacgcactgatttaatcagcgctcccaatatcaatccggaatcccatatttttctaaaaccagagaacttacaagtaaccggatcgtttaaagtgcgcggcgcttgtttcaagatcgctcagcttacggaagaagagaaatcgcatggcgtagtggcttgctcggcggggaaccatgcccaaggtgtggcattagcggctaccgctcatggtatcaagtccttaatctgcttgcccgataacgctcctatctctaaagtcgaggctactaaatcttatggggcagatgtatgccttgtcgaaggtgtttatgacgatgcctataacaaggctttacaattgaaggatgagaaagggtatacatttatccatccgtttgatgatgaggatgtgatcgccggacaagggaccatcggtttggagttattagaacaactcccggaagtagaggctgtaatcattccgatcggagggggtgggctgatctccggagtcgcctatgccatcaagaacttgaacccggatatcagagtttacggagtgcaagccaaaggagcgcccagcatgttaaactctatcgagcatgggaaaatcgaacgcctcgaaggtgtccgtaccatagccgacggtatcgccgtaaaagaaccgggaatacatactttcgatctttgccagcaatatgtggacgagatcgtatccgtgacagacgatgagatttccaccgctatcctcgcattgatcgagcaacataaattaatcgccgaaggggcgggtgccgtagccgtggccgccgccatgtttaataaagtacccatcaaagggaaaaaagtaatctgtttgatttccggcggaaatatcgacgtgaatatcctttcccgggtaatcggacgtggtttgcagaaatccggccgctcttgttccatgacgatcgaattggtagacaaacccggacaactacagcacgtatctgaaatcattgcctctaccggcgctaacgtagtatccgtatatcacgagcgtgtcagccatacggctgatatcaatggctgttatctgcggttggagatggaaacaaggaatcaacagcagattaatgagatccggcaattactcaccgtttcgggatataagatagtggaaggataaacaattcgcccctaagcatacaattgattggcaaaccattactgtgccactactttccataggcgtggcacagccgtgccatcttagtggcacacttgtgccatccttatggcatagctgtgccatcacggtggcacaagcgtgccctaagaatggcacaagctaaatattaatatattgtcttaatgtattcacatactcctccatcgccaagcgtcctttatctgtgatccggcaaaccgttcggggcttcttcccggcaaaccccttctcgatctcgatataaccagcttcattaagtttgtccaattggacgctgagatttcctgcggtagcgctcgtcttctccttgatatagacaaactccgcctcctccaccgatagtaaaatggacatcaccgctagccggagttgggaatgcaataaaggatctaattctttaaacattgttttttagctttattattaagaatatgcccgggaataatcatcattaccacaaatgaaaggccaaaatacaaataccataaaaccgtgacaggatcatgatttatcaaactcatcagcatgtggataactaaaacgaaagcaaccaccggagagtaaatcatccatttctcccgcaagataatgccatttatagatacccctaatccacaatataataacgataaaggaagcatcaatataaaattgacggattgcccataaagcgcacaaaataccgcgatcaagacgaacgtcagtccaaacatacagccaaacacttgccataccttggagatcgtcttgtccgtataagtcaccacggccggctcacaacctctttgcttatatgaaataactggtccgacagcaaacatgagcatccatccccaagaccaaatataattttgagtacacaatatcaaggaggatatcacgaccgataagagcacagtaaaatatccccaataaagtaacacattgccactccctactttcatgtttcgcttactggagttaatcatctgagtgataatatccagactttctttttctgataattttctatcttccataattgtatttattttatgttatttttcattcaggcgactccgttcggaaccggaacctatctcaatcttactcttccttactttctttccgctattgaaattccatgtcaacgcaaccttaaagacccttccagtaagtccgttttcataacgggatgatgttcgataaacatccaacgtactggcgtactcattggcttggttaaagatattatcgactgaaactgccaacaatagcttatcattaaatagtttctttctcgccattactccaaccgtatgccggggggcgacctcgctattaccggaatatagccggctcgttccactataccgggcctccaccgtaaaacctgccggcaatgcaaaggtagcgatcgcattggcaaaccctaaataatgagacaagaaagaagacaattccgtcatccggatatcctgccgtacgcctatgaaattccctgtcaagttacaccaagtaaagggttgatacggcaagctgaccgctacaaaccaatggttttcccgatcgtgattttcatacgtgatataggatacatcgggattcgccacatcttgtttacagaactcccggatcaagtcgtggtgcaagtttcctcctacagtcaccgtataacgataattataaaccaacgttacactgaaacgattgatataagtaggacgcagatagggattcccgatctggtagctatagtccgaactctgtatacgattcggattcaaggtatagaacggaggacgttcgatattacgagcatattgcccgaccagcatccacctcttgatgggatcgaacgcataggtcacgctcaagttcggaaaaagatccagataatcccgactaaaatcctcacttctatccgacgtcttggaatattccgcacgtacccccgcagcaaacgaccagttcttgatctccgcagagaaagaggcgtaagctcctactatattttcattatatctcaaggtatatccatattcctcatttggaatccagctaccactagaggttaccccctcatacaaggaatgatcatccatcaatgtataggcatatttggtcccgattttcaaagacattttttcacgcaaattcttttggaaagaaatatcggttgtcgccatatcataatccgccgccgcatgactccggtaaaccgtgtcatagctccaactagactgttcataacagatcgtatggaaattatccccggttgatcgcttacttacgtaatcggctatgaccttaaataccgagcctcgatcatccatttcgcgtaagtaattgaccgtagcggaaaacgtgttataatcatccttctgtcgataattccccgtactcttcataggataagagttctttactaaatccgtttgactccaagatgttccatccgaagcttgattgatatattcgatctcagctccgacactattcagcgaatcgatctcgaaaatagccccgacacgtccattcccatatttggaatccgtatcatacaaagattgagacacaaacttattccccaccgttccgtattccctgttggagttgatctctcctttatcccggggagtaaaagtacccgataccgctccattcaagctccatttcccgacacgtgcatttacggacgccgatggaatatacccttgtaaaaatggagacaatgacgtacctaaagatacatatccttgcataccgttatccggacgtcgccgcaatgagatcttgatcactccacccttagttgaggcctcatactcaactcccgcgatcggtattacctcaatcctttttatatcctccgatttcaaagaccgcaaataagccagtagctcctctcccgttaaacgaatctcacgatcatccacaaacaccttcgttccttgcgccccgtttatcgagatagtttcatccgagagccagacacccggtgcctgtgataataattccgtaccatcctttccggcagatggcatgaccgacatgataaagcggtccgccttccgctcgatattcttcgcttgaacaacgacttccctcagaacatggttcaatagatctagaatcaaggaatcccgccgttttatcggcaagatcagctctttccgtaaaggctcgtatccgaggcattgaacaacaagcctatacttcccagcctccgcctccatgctaaaatcgccatcactattggccacggcaccccctacctgtttttctcccgataaaagcacagcggtcgcatattccacggcatttccctccgcatcggaaacatgggctttataaaccgtttgtcccgagatcttttgggcactacccccgcctatcgccaaaatccagagccatagtagtaaaaaccgtaccatggctctattgatttaccggataatacagttttaatttgaaagtcgcttcctcatccttcacctcgcaacttttcaacacatatccttccgcaggcccttttccttccagcatatccatttgccaattctcgttctcgtcatggaatacggacagatcaaacttttcccaatccacgttttccagccggatcgtaacctttcctttctcagacttcgccatgccataaacaggcttggtatcttttcctgactgagccataactaggatattcccatggttaccacgtatatttccaatctctacaataatagtacgtgcctctatgcgaccacataccaacatgaataaagataatatgaataaaactcgtctcattttagtatcctcctcttaattattatcactgttactgcaaacaagtttattttataaaccatccatggataaaaaaatgcaaaagagctgcgcatcactctttgcacatcgcaaatatagacaagtttattttataaaccaaataatattataaaatattccaataaaaatttgactctgcaaaatacagccaaaatcccccactaaccctcctagaaaacacgtacatgctttcaaaacaaccattttaagtttgaaacaaagcaactttttcgctatattgcgcacatttagaatatatatgaacaggaccaacatacaaataactaaagatatgaacgaacgaataattgctatacaagcagatattacgacattggatgtagacgccatcgtaaatgccgcgaacaatagcttattgggaggtggcggcgtagacggtgccatccattgggccgccggtccggaactccttgacgaatgccggactttacaaggatgcccgaccggagaggcgaagataacgaaaggttatcgattgaaagcccgtcatgtcatacacaccgtcggtcccatctaccgaaacggacaacacggagagccggagctactggaaaattgttatcgaaactccttgcgattggcgaaagagaacagactgagaacaatcgctttcccatcaataagcaccggcgtatatggctatcctatcgaggaggcggcacggatagcgatccgcacgatcgataccttcctaaaagagaatccggaaatccagcaagtcacgatgtgctgtttctccggatacgacaaatcggtttatacgaaagcgctggaacaaattacaactcacgagccgtaatgtggaaacacccttgcttgcgttcgtgcttgatatagcaacgatccgccctgcgcaaatcacgaagcacggaggcaagcaccattttcaagcggtccttatcaatatttaaggtatctttctcatctatcttagtatagcgtacccatgatacatcgaacgtagttccgtattggtgggcagagttgagagaagagttcgtattcctttttctcaatttcttgacatcggcaaccgtacgggttacactggttacctttattttatagatggaagcattcaagtttttcaatgagtcttggaagtttttcccgatatcctccagcagattagcggcttccggcaccaaatacggaatagagtgcgtcaactcctctacctcgtaatagtcattcgtcttgatctccaccatatcccgggaggcgtgctccgctccttccctcgaagagacaggctctatgccgatcttcttcgcaacggacaaatgaacgtcattcaaatcattaaaatcacgattatagcttccattgtaccaaatcttcttcaattcacctcttttctccttacaagaagaaaaagccgtcgccgacacgatcacgaccagcaacaacatcacattaaacacagtcttcatcttcatttccttcgttttgcctgacaaacatacggaaaaatccgaaattcccccttaactccaattagtttttctctaaatggtagacgaacggctgaaagatgtgttcccgtgaaataaaacttctccctttgcatcaatggataaagaatattactaattttgtaacttgattcgaataataaaaaatagcacatctttttgaagcgtaatttaataaaaggaatagcggatgattgaaagaatttatattcttgaaagcgtagacccggtaattttctacggtgtgaataactctaatatgcaattgatcaagacattgtttccgaaattgcgtatcgttgcccgtggaaatgtgatgaaagtgattggagatgaagatgagtccgagctttttctcaagaaaatccgtgaggtggaaaaatactgtgaggagtttaactcgctctccgaagacgtgattctggatattataaaagggaaaggccccacggtcgtgaagcaggagaacctgatcatccacggcatgaatggcaagccgattaccgcacgtaccgagaatcaacagttattggtaaaggctttcgagaacaacgatctggttttcgccacaggacccgccggttcgggcaaaacattcgtcgctatcgccctagccgtaaaagcattaaagaataaggaagtacggaagatcatcttaagccgtcccgccgtggaagccggagaaaaactgggtttcttgccgggtgagatgaaggataagctagatccctatctgcaaccgctttacgatgccttgcaggatatgataccggcagccaagctgaaggaatatatggagaataacgtgatacagatcgccccgctagcgtttatgcgcggtcgtaccttgaacgacgccgtcattatattggacgaggcgcaaaacacgacgacgcatcaaatcaagatgttcttgacccgcttgggtatgaacgccaagatgatcgtcaccggagatgtcacgcagatagaccttccgccttctaccacgtccggattgatacaggccatgcaaatattgaagggcgtaaacgggatcggtaagatcgagttcaccaagaaagatattgtccggcataaacttgtccaacgaatcgtagaggcttatgataagttcgatgataaacggaagaaagagatcaaagaggcaaaagagaagaaaacgaatatagacaacaactaaaagtaagagtcatgaagaaggcattagttaaaacagacttcaatttcccgcgacaaaagagcgtataccatgggaaagtacgcgacgtgtacaacatcaatgacgaggtattggtaatggtcgctacagaccgtatttccgctttcgatgttatcttgccggaaggtattccttacaagggacaaatgttaaaccagatcgccgccaagttccttgacgctacgactgatatttgtccgaactggaaaatggcgactccggacccgatggtaacggttggcgttcaatgccaaggtttcccggttgagatgatcgtacgcggttatctgtgcggaagcgcatggcgtgcttataagagcggcgtgcgtgagatctgcggcgtgaaactaccggagggtatgcgtgaaaaccaacgtttccccgaacccatcatcaccccgaccacaaaggctgagatcggagagcatgatcaagatatctctaaagaggagattctcgctaaaggtttggtctctaaagaggactacgaggttcttgagaaatatacgatggccttgtttaaacgcggtaccgagatcgctaaggaacgtggcttgatcttggttgacacgaaatatgagttcggtcatcgtgacggcaagatctatttgatcgacgagatccatactccggattcctcccgttatttctactcagaaggatacgaggatcgtttcgccaaaggggaaccgcagaagcaactttccaaggagttcgtccgcgaatggttgatggaaaatggcttccaaggtaaatccggacagaaagttcctgaaatgacaccggagatcgtagaaggaatcagcaaccgatatatcgaattgttcgagcatatcacaggggagacttttgtaaaaggcgagactgataacttgctgaaccgcatcgagaaaaacgttaccgaatatttacagaataaataagataccgcacatgacacagtatggttcagagacaatacttccttataacaaagaggaacaaaagggtacgcaagtcaaacgtatgttcgactcgatagccgaaacgtatgatcaactcaaccatactctctcatttggtatcgacaagatatggcgcaggaaagggatcgctttcctgcgtcctttctctcctaaaacgatactggatatcgctaccggtaccggagacttggctatctccatgtacaaaaagctgcgacccgaccatatcgtcggtgccgacatctcgttaggcatgatggaagtgggacggaaaaaagtagctgccgccggttattcggagtatatatccttcgagcaacaggactgtacggccttgacctacgaggaaaactcgttcgatgccgtaaccgccgctttcggggttcgtaattttgagaacatagagcaaggtatctcagagatgtaccgggtgctgaaacccggtgggcatatcatgatcttggaactttccacaccggaacattttcccatgagacaactctaccagatctattcaaagaccgtcatcccctttatcggacgtctactctctaaagaaaaagtcgcgtataattatttgccggcttccatcaaggtagttcctcagggaaaggtcatgacggatttactcacccgccaaggcttcaagcaggcccgtgtacggacctttaccttcgggatctgttcattatatacaggatctaaagaataaacaataaaaaggttatgcagaaatatggcttactgggatatcccctcggacattcgttttctaaaacgtatttcaaccagaagtttgaggcggagaagatcgacgctgagtacttgaatttcgagattccctctatcaaggagattaagaacgtaatcaaagaaaaccctgaacttaacggtttaaacgtgaccattccttataaggaacaagtaatcccatatttagacgatttggatgacgatgcccgtcagatcggagcggtaaatgtcatcaagttcacaaaaggtcttttcggcaaacttaaactgaaaggatataactcggatattatcggattcaagcaatcgattgatcctttattgaaagaaacgcaccggaaagcgttgatccttggtacgggaggggcgtcgaaggcagtcttccacggactgaaacagctaggcgttggtgccacgctggtttctcgcaaaccgaaagaattttgtatcacgtacgatgagattactccgaaaaccatggagcaatatacggtgatcgtaaacacgactcccttaggtatgttcccgaatatagactcatgtccggatatcccgtacgatttacttacgccgaatcatctattgtatgatttactttacaatccggatgagacccttttcatgaagaaaggaaaagaaaaaggcgccgtcgtgaaaaatggtctggaaatgcttctattacaggctttcgccgcttgggagatctggcagaaatagatcgaacgatatctttccaaccacatgatttgatgaagctagcttcgtgagccaatgaagttagcttcgttagtcaatgaagttaacttcacaagcgtatgaagttaacttacttcaaccaagtcaatacatagtccggtgtaacttgatatgccaactcatattcccgacatgcctcggtccgggtttctcgtcccttaaacgtcccactcgataaataaggaaaaggattcacgtgaagatgcttttgaaagtccactccttcctgcccgattatcttgaacaaggtttctttggcgcaccaatggattaatagatgctcgacctcatgctccagatcgatacccgcctcttcctccggattcataaagcgacttcgtattttcaagatccggtccgaacgatactcgatatcgatccctgtcggacgcttatccaagattaccgccacataatctttcgtatgagatatacttatatataaaggtacgcacgcgaggaacggggcacccgtagaatgatagtcaacccttacctcctctcctaaaagctcttttaaaagcacccggctggcgaaacgttcctgcctccgcttctctgccgatacccgctccaaaaaagaagaatagtccgctttatgctcaagcatccccaaaagctcatcagaactttcttccattttccagactccatgcagcggcgagagttgtttatatagcaaggccatattattctttccaactaaaagtttgtataagttctatgatatcttcccggatatattggatagcgggagctaatgaatccgcattgggtttacagtcaaaatacaaggctccccggaagaaattcgatacactatctgtcaacaggaattgtatgggagaagccgattctccatccaaaagaaacagcgagccataaacgtttgcggcagggttggaatacgctttctccgatatccgattctccgactttatttggcgggcgacgaaagagcggctttccgtctccaccgtcaccaaggacgcgggagtaattggcaaatagctgcaataaagcttagcctctaactccggatacgagatattcaagcccgtaacacccatcttttgatccagcacctctatgaccgcagtctgagagacatcaaaattaaaaggcaggtaactgagatcaagcggtttatattgtgccttcgaaggttcgatacgaacatagccccgtggcttcggcgtatattccacacacgaaatacagcatatccctaaaaacagagaacctcctatgacagcagctatccatttcataaacatttacttcgtatctttcccattctcatcattccctgtaccttcagggatacggttaaatttaacctttaatatcctcctgttatccacctccagtacttggaaacgatattccttaaaatctataatctccctacggcgtggaaaatccccttttatctccaacaaaagaccggccaaagtttccacttcttccgtcaatttaccaaaatctgagggatcggcatcgataacccggaagaaatccgtcaataatatctttgcctcaaagatcaagctaccgtctgctaaacggatgaattgttgctcatcctcatcatactcatcggagatctctccgacaatttcctctaggatatcttccatcgtcacgataccggaggtaccgccaaactcatcgaccacgatcgccatatgaattttattggtacggaactcttccagcaaatcatcgatcttcttggtttccggcacgaaataggccggtcggatcaagctctgccaacggaatgtatcgggcttgtcaatatagggcaataagtccttgatatataagataccttttatattatcctcagtctcggaatataccggaatacgcgaatagccggatttgataataaaatcaaccacctcacggaaactgatcttgatctcgatatcttccatatccaaacgaggagtcatgatctcatcagcggtcttattataaaacttgataatctccgccagcatctccttctcctccgggatctcggtagaggttagctctaacgctttagaaagctcatctacagagatatcatatttctttttcgctaacgctttattgatgaccgatgtggaattaaccaagattttcgagaatgggcggcagaagcgttccaaaccacttaatacggaggctgaaaaacgaacaaaacgcaaagaattcttctgtgcgtaaatcttaggcatgatctccccaaaaagtaaaagcaagaaagtcagtagaatcgtctcaagcacaaagcctagaagaggagcggccgagaaattaatccaagcgttaatcgcataggtacacaacataacgaccgccacatttacgaaattattagcgatcaatatagatgccaatagatactccgaacgttcaaggagacgtttgataacaggatctgccgggcgattctcttccccgatctcatttaggtcgcccggggttagagaaaagaatgccacttcagaggccgacacgaagccggaaacaaacagcagtaaaaaggcaaggcttaatgcgatcacaggacccgctgtcagcgcctgcaccgttacgttttcaaataagcccgataaataatagtccgagtccaagggaaacagtattagttaaacaatatcagaacgggagatcatccgcgtcactggattctgagaatgcgctaggctgcgaggcggctggctgttgataagcggtatttggcgccgtggtcggttgagccgattgtccttgccccacattgggctgcatactaccgctttgtgcagtcgtatttccaccatcggccggacgggaacccgtactgtaaaactcgatacgatccgcatggatctccgtaacatatcgcttcacgccgctttggtcatcataattacgagtacgaatcttgccttccacatatacaccggaacctttacgtacccatttttccacgaaaggaaccaaatcccgacgaactacgatattatgccactccgtacgttccggaaccaccgttccatttgccaacgtatacccacgttccgaggttgccagcgggaaattagcgacagcggcaccactgtcaaaatagcgaacgtcaggatctttgcctacgttgccgatcaatataaccttattcaatgacataattcaaattcttaataaccatacaaagaaacacaaattcaatcattctcacaagtttccgtttaatttctctaaataaatatgtatcagccggggaacggcatacttctcaatatcccggcaaggcaaagagagataattccccaaggattccggaacctgctctatctctatttgatagaaagaagcgtataaaatttgatgggagagcgtatgctttacattcgataacccttgggtgatactcaattttccagcatctcccaataggttacggaaggcttgcgtctcacacaaaccggaaaaatccatcgcatgatccgtctcgatcaaaggaaattcatacaagccggtccagatatccttccccgcccgtctgttcatccaagtttgtcctttatatataatgtatagatagtggaaataacgatcccttgtcttcgtcttattttgtttcaccggataagcttgcacattgccggaagcgaacgccatgcatttatcttttagcgggcacaccccgcagtccgggttttgaggaacacattgcaaagcacccaattccatgatcgcctgattatgcgtccctgcgttcttagggtccaagatcattccggccagttccgcgaattgctttttacccttcgtggtgtcgatcggcgtatctacggcaaacaaacgggaaagtacccggtacacatttccatccacgaccggacacggttggttccaagcaaaggagacgatcgccgccgccgtatactccccgatacctttcaaggataatacctctttataattctccgggaaaaccccgttaaaccgctccatgatagatttagccgccgcatgtaagttacgagcccggctataataccccaagccctgccaatatttcagcacctcatcctcttccgccgccgctagagatgccacatccgggaaacgttcggtgaaacgcaaaaaatactccaatccctgtacaacccgggtttgttgcaatataatctccgatatccagatgatataagggtctctcgtttccctccaaggaagctctcttttataggtttcataccactcaaccaatatccggctgatttctaactcactttcatactgtaacataactgctccctttctcacttttcaacatcataactatttgattaccgcaaacatacatatatattacgaatcgagaagaatctttttatttaaaaattgaagctcaattctttttccacttaaataaaaagctatatatttgcattccaaaaaattaataggtcaaaatcaattaattaatttatagacatgactaaagcagatattgttagcgagatttcaaaaagcactggtatcgacaaacagacagtgctagcaagcgttgagtccttcatggatatcgtaaaaagttctttagcccaaggcgaaaacgtttacttgagaggtttcggaagtttcgttattaagaagagagctcaaaagacagctcgtaatatttcaaaaaatactacgatcatcatcccggaacacaacattccgtcattcaagccggctaagacttttattggtgaagttaagtaattaattattatacgtttaatttaaaattttaaagcgatgcctagcggaaagaaaagaaaaagacataaaatgtctacgcacaagcgcaaaaagagactgaagaagaatagacataagaagaaataagtctatctaacgaactctaaagaacaaacttaataagtgaccttttaagtttgttctttgcgtattttataaggtctgattaaaaaaacacatcttaagtgattagtgaattagtagttgatgtacagcccaaagaggtatctatcgccgtcttggaggacaagagccttgtggagctccaaaaggaggcccgcaacgtctcgttcgccgttggtgatatctatctaggtaaggttaagaaactgatgccgggcttaaacgctgcgttcattgatgtcggttacaaaaaggatgcgtttcttcactatttggacttaggtcctaacttcaacacccaacagaaatatttaaagcaattgctgagcgatcccaaaaaggcgccggtactgtcgaaaacccagattctaccggagatcgaaaagaacgggagtattagcgacgtgctgaaagtaggacaagaggtgttggttcaaattgctaaagagcctatctcgacgaaaggtccccgattgacttccgagctttcttttgccggaagatatatcgtgctgataccgttcgccgataaagtatctgtctccaccaaaattaaatcaagcgaggaacgggctcgtttgcgccagttaatccaaagtatcaaaccgaagaatttcagtgttatcgtacggacatcctcggagggcaaacgtgtcgcagagcttgatcatgaactaaagacattggtgaaacgatgggaagataatatcgtgaaggtgcctaaactcaaagctccggctatcgtttatgaagaaacggcacgtaccgtagctttacttcgggatatattcaacccctctttccaaaatatttatgtaaatgacaaggaggtctacaataatgtccgcgactatgtaagcttgatcgcaccgggacgggaagaaatcgtacagttatatacgggagagcttcctatctttgacaactttgcggtcaccaagcaaatcaagtcgctattcggacgaactgtcacttacaagagtggagcttacttgattatcgagcacacggaagccatgcacgttatcgacgtgaacagcgggaaccgttccaaaggcagcgatgcccaagagaagacagctatcgacgtaaatatagccgccgccgatgagatcgcccgtcagctccgcttacgagacatgggaggtatcatcgtcatagactttatcgatatggcagaggctgccaaccggcaaaagctatttgaacacatgacaaaggcaatggcaaatgaccgggctaaacacaacatccttcctcttagtaagtttggcttgatgcagattacccgtcagcgggtacgtccggcaatggacgtggatacgtcagaagactgcccatcctgtttcggaacaggaacggttaagccttccatcctgtttaccgacagtctggaagaaaaaatagattgcttagtaaacagacatcacgtgaagaaattcaccctgcacgtacatccgtatgtcgcagcgtatgtgaacaaggggttgttccccttgagcatgaagtggaaaatgaagtacacccatggtttaaaagttattcccaatcaaagtctcgcctttcttgaatacaaattctttgatgccgacaagaatgagcttgacatgaaagaagaaaaggaaataatcaacaaataacaagagaagccccggacctattagaacggttccggggctttttgtatcctgccaaaccgtcaaaatgtcacgattcatgacacgtattatttattttcaaacccgaacttctttggcacggcatttgttgaatactatgtgaatcctttcaacaaggaagatgacggacgatgaataataacaattaaaatatttacaatcatgggaaagattattggaatcgacttaggaacaaccaactcttgtgttgccgtattggaaggtaacgaaccggttgttattgcgaacagcgaaggtaaaagaacaacaccttcaatcgtagctttcgtagaaggcggcgagcgtaaggtaggtgatcccgcaaaacgtcaggctatcaccaatcctgaaaagactatattctctatcaaacgtttcatgggtgaaacttatgaccaagtacaaaaggaaatcaatcgcgttccttataaagtagtgcgtggtgataacaacactcctcgtgtagatatcgaaggacgtttgtatactccgcaggaaatctcagcgatgatcctgcagaaaatgaaaaagacagctgaggattatttgggacaggaagtaacggaagccgttatcacagtacctgcttactttagtgacgctcaacgtcaggctacgaaagaggctggtgagatcgcaggtttaaccgtacgccgtatcgtaaacgaaccgactgccgcttctttagcttatggtttggataagacgaacaaagacatgaagatcgccgtattcgacttaggtggtggtacattcgatatctccatccttgagttaggtgacggcgtattcgaggtaaaatcaacaaacggtgatactcacctaggtggtgatgacttcgaccacgtaatcatcgactggttggctgaagaattcgaacgagaggaaggcgtagacttacgtaaagacccgatggctttacaacgtttaaaagaagctgccgagaaagcgaagatcgagttgtcaagtacgactagcacggagatcaacttgccgtatatcatgccggtaaacggtattccaaagcacttggttaagactttgactcgtgctaaattcgaacaattggctgacggtctgatccaagcatgtatcgaaccgtgccgtcaatccttgaaagacgcaggtttatcaacttctgatatcgacgaagtgatcttggtaggtggttctactcgtatcccggctgtacaggctatcgttgagaaattcttcggtaaagctccgtctaagggcgttaacccggatgaagtagtagccgtaggcgcagcgatccaaggtggtgtattgacaggtgaggttaaagacgtattgctgttggatgttactccgctgtctttaggtattgagacaatgggtggtgtaatgactaaattgatcgagtctaacacgaccatcccgaccaagaagtccgagacatttacgactgccgtagacaatcagccttctgttgagatccacatcttgcaaggtgagcgttctttggctaaagacaacaagtctatcggccgtttccacctagatggaatacctgccgcacaacgtggtgtccctcagatcgaggttacattcgatatcgacgccaatggtatcttgaacgtatccgccaaggataaaggaaccggtaaagtacaaagtatccgtatcgaggcttccagcggtttgagcgatgatgaggttaagcgtatgaaagaagaggctgccgcaaacgcagaggccgataagaaagagaaagagcgtatcgataaattgaatcaagcggatagcatgatcttccagaccgagaaacaattgaaagatcttggcgacaagcttccggcagacaagaaagctccgatcgaaggtgccttgaacaaattgaaagaagctcataaggctcaggatatcgcaggtatcgatgctgctatggcagaattgaacagcgtattccaagcagctagccaagaaatgtacaacgctcaaggtggcggcgctcaaggcggcccgcaagcagatcctaacttcggtggtcaacaagctggcggtaacgcaggtagcagcaacaacagcaaagacggtaacgttacggacgttgactttgaggaagtaaaataaaaagaagcggttttaatcgctcctttactccacataagatagaaaaacggctatcgggtccttcgggatctgatagccgttttttattttagccctatatattcaataaaaaagccattgatatccaataattattaataagtttgcactcgcataaaaacactcattttaaattacgattaagggcaacgtactaattttcgacttatgctagcgagatctatacagaaatattacatatttgttctactttttctgctagccattctacagtcctcttgtcaacagtcgggaaataaatatcgtatattagtagtacattcctatgaaagcgattatgtagcttataaagactgcgatcggttgatccgggaatccctcgagaaaaaggggattaatccgtcgatccaaacattctatttgaactgcgagcaatatgcggcacccgccgaagaaaaacggatgtacctgtatctagattcgatctctacttggaaacccgatctgattttggtctacgaggatcaagcgacttacacgttaatgcaatgccatcatccgctaatctctacagtccccattgtatttggcggcgtaaatttccccaataaggcactattagcgcaatattcgaatgtttccggattctgggacgagcccgactacgtcacgaacatccgcttgatagaacatctgttgggcaagtctacgatttatatgttgcacgatagtacgtatatagataggcacattaaggctacgttacatgagcaatgtgctcaagcagacattcgggtcgataataatcgcatcatgtatataccggtagagatcgctactttggacagggtcaatcaaagcttaaaacgaccggatagtacgaccgtcaacgtcgtgcccgtgcaaggagacaagctatcagctgtttcttggtacatgagtaaacacgtcccttacatctactatctacaggccaaacgggattaccgggtattgaacaccagccgtttttccagtaaaccctcttttacggcgatcaacgaggatctaggatatacgaataaacttgtaggtggctatatcacctccttggaaacccaaatagaagaatctaccgatagagccgcggaaatattaaaaggctcccctagcgaatcattcccacagataacaaagagcaagaagaattatgtatttgatttcaatgaagtcaaatattggaatatcgataaaaggcttcttccgaaggatgctatacttttgaactttccttttaaggaccaatatccaagattattctggagcttgataatcgtagtcagcacgatgtgctgctttgtcttcggtagcttcatcatcatgtatacccaagaatccaaggcaaaacgacaagcgcaaaaagccctattacatgaaaaggaatcattagcggaagccttggagaaagccaatgagtccgaccggatgaaatccgtattcttggctaacatgagtcatgagatacgtacccctctaaatgcgatcatcggcttttcaagcctaatcgccgaactggatctgacagcggaagagaaggagcaatacgctaatatcatcacgaccaataacgagttattactaaagttagtcaatgacatattggatttggcaaggattgaatccggaggtatcgtctttcataaggaatcctgcaatttaacggatttagtgaaaaccctttataaacaacatctttccgatgtccccgaaggtatcgaattcaaggagaaatgccccgatacgccgatctgcttatattcggataaggagcgactttaccaagcgctcgagaacatactgaaaaatgctataaaatttacttccgcaggctttatagagatcggttacgagtattccaccaatgcacaagacgtccgactttatgtgcaggatacaggcatcgggatctctcccgaggaccaagaagcgatattcgagcgtttcaagaagctggatgatttcgtgcaagggacaggtcttggattatcgatctgccaagctatcgtaaaacaattaaacgggcgtatcttgctcaagtccgaaaagaataaggggtgccgcatctccttggttttcgaattataaaccaacctcagaagccaagaaaaatagacatttgtctctttgatatccaattactttttatacatttgtacctattatattgaagctatacacatggcgaacacttcttatcgttatctttttttattgttgcttccattatttctattggtcgcaaattcttgcgaacgctcaaccacggaaaagcgtatcttgatagtccaatcttatgagccggactttcaagcctataaagatatagaagaggcttttaaaaaaggattccagaaggaaggcattcatgccagtatcttcacgttctatcttaattgcgaagcttatcaatcgccagaagagaaacaaagaatatatacggaactcaatacgttatctttatggaagcctgatatcataatcgtaaacgatgatcaagcgacctattccttattggcttgcgaacatcctttattagatagcgtacctatcgtttttaccggagtcaactaccctaacatacccttaattcaaaagtatcctaacgtatccggattttgggataagccggactatcggaaaaacgtcgaacttattgagcgaatcatgggaaaatgcgtgattgtacgtgtctctgatagtacagctcttgacaaaaagatcctgaaagatatggatgagcaaataaaagggctatgctccaaggctagacccgattaccttaaatatccccagtattcatccccatccgataaaaagagatcctcttctttagtgcggttcccaaaagtaccgttcgattccctctatatacaaaccattcaaccccgtaccagttccaacttgatctgggggttaggtacaagtacttacaacaaggcctaccttgctaccaaaagagattatacctcgatagccttaggtaggttctgctcatttcccagcttctcggcgatcaacgaatccgtaggatatgacggagacttcatagggggatatatgaccccggtagagagtcaaacccaagaagccttacgacgagctgccagcatactcaaaggcacaccggccaatagcttcccacaaataacggaaagcgccaaaaactatctgttcgattacccgactttaaataaatgggggatcgattggaaagaactgcctcaaaacagcatcttcttgaacatgccctttgtggttcgttatcaaacatatattattctatgcgggattcttctaaccctatttatcctatggacgcttttctatcaaagagtacaataccgtcgcgaagcctctcacaagaaacaggctcaagaaagtttacggaaagagaaagaattcctctcgttggctttagagagcggtgatattttcgcattccgatacagcaacggcgtattcgagttcgaccatgatttctataagtcgttggatatgccgataaagccgatcacctccacgcaattccaagagtctatccacccggaagaccgggaagatttcatccaacataaacacctgcttgatacaggattcccttcccgtaagatcacccgccgccgatataatttcaacggcaaagggcatatatggtgggaattcagatatgcgcaagcgaagaatggacaagactccacccgcaataatgtcggagtaaacgggctctgcttaaatatccaacaaagtaaggaagtagaggaagatcttatcaaagcccgtataagggccgaggaagcggaccaaatgaaatcagcgttcctcgccaatatgagccatgagatacgtaccccgcttaacgccatcgttggattttcggaactgctaacaagcgatatggaaataagcccgaacgagagggatgagttcatgcaagttatcagtaagaacagcgacctcttattgaaattaatcaatgacattctcgatctatcccgcatcgagtccggtaagatgtcgtttaccctcacgaattgtgacttaaacgaattactatcccatatctaccgcacccatcaattgttgatgccccaaggcgtagtgcttaaaatacaactgccggtcctcccggccattatccaagcggacctacatcgattaacccaagtgattaccaacctcataaacaacgccgcaaaattcacgacgcaaggatacatcttgattaaatacgattatacgcaagataaacgttggatccagatctccgttaccgatacgggcaaaggcattcccgcagataagcaagcccaagtattcgaacggttcaacaaactggacgagtttgcgcaagggacaggtctcggactggcgatctgccaaattatcatcgaacacttcggaggatatatcaccctagaatccaaagaaggggaaggtagcacattcatcgtgaccctcccctacactcccggattatcggtataagattattttttcttgaaacgcaagaacggcaatacaataaataaaggtatgcaacagatcattacccagataaagaaatgttggtaaccgatctgctcctgtatccatcccgatgccattcccggtagcatcatacctaacgccatgaaaccggtactgatcgcataatgcgaagtcttatattccccctcggcgaaaagcatcagatacatcgtataagccgtaaagccaaatccgtagccgaattgctcgacagcgacacaagcgtttacgacaacaatactctccggcatcgtataagccatatacaaataaaccagattcggcaaggagatagccaatgccataggccataaccaagtcttcaagccaccccgggatatagccagacctcctaaaacccctccgagcaataaggagatcactcccaccgtaccataagcgaacccgacctcaccggtactgagcgccaacccgccaacctcccgcccatccagcaggaaaggagaagccaactttaccaattgggattcccccaaacgatacgtcagcataaaaagcaaagccgggataatccctttcttgctgaaaaagctcacgaaagtattgccaaactccaccaagatggtatgaggggtgatattcgtacgttgcgcgtcactcgccggacggggtaagatatacttatgccacaaggccaaggcgataaaggtaccggccaatacgaaaaacaccaggctccaagcaaaggaaatccgcccggtactctcctccaaaagccccgccagcatgaccagcagaccttgtcccgttagcatcgccaccctgtagaacgtatttcggataccgatgaagaacgcctgttgctcctccgtcaagcccagcatatagaacccatccgcggcgatatcgtgcgtagcggaactaaacgccatcaaccaaaagaaagccaaggtaaaccgcaaaaagaaatccccgggaaggacgaacgccacacctgccattcccccgccaatcaatagctgcatgctataaatccaccaacgcttcgttttaatcaagtctacgaacgggctccagatgggcttgatcacccaaggaaaataaagccaactggtaaacaaggcgatatccgtattcgagacgcccaaacgtttatacatgatcacagaaagcgtcatgactaccacgtagggcaagccttcggcgaaataaagagacgggatccaagcccaaggattacgtttttccataataagaaggaattaaacgattagaagtcaatactaaatccatccgcatccttccacgccgggaacttagcccggaactcatccagctcgctcttcttcaaggtacatgtccgggtgatttcctctcgttttccggcatcagccaatttctttccttttgcgttataaatcatggaatcccctctgaaaagaaaacctttcccatctacccccacacggttcacgccacagacataagccatgttctcgatggcacgtgcatgcagcaatgccttccacgccttcttccgggcctcgggccaattggctacataaatcaaaagatcatattcgttattcacgttgcggctccaaaccgggaaacgcaagtcataacaaacctgcaaacagatattccagcctttataaggcacgatcagacgtttgtcgcccgccgagaaatgcttgtcctcttccgccatacggaacaaatgacgtttatcgtaataatactcctctccttccagagtgatgaaaaaagcccggttgtagaactttccgttatctttcgcgataaaacttccagccacggccagtttatatttcttagcccattcctttatagtcggtacagtccgtccatccatcgtatcggcttgtttctctacgtccatggaaaatcccgtagtaaacgtctccggcaataccgctaaatcggttcttccactaacacggcgcaacagttcgccataataacccaagttctcttcacggtcttcccaaatgatatgggattgtatcatactgatacgtaagtcttcagtcatagaataaagatattaaggtaataaaaagacatattgtgacaaggaaacagtttcatggtgaagaaacggtagtttcttcatagcaaaacttttgttttcctatagcaaaactcttatttcttcaccatgaaactcctatacctgtacgaaattctcaggatggcaggcagtaactccccgatacatctctcgtatcgtatggatatctttatccacatcacctgtcggataaaaaacacctttcgtacccacctctttctttccataatcaaaataagccaccacgatcggcacgttcgctttcaaagcgataaaatagaatccttttttccattccttggcccgcttccgggtaccttccggtgtgacggccaattgaaaccgctcactggtcttgaaacgttccaccatctgatcggtcaccgacgtacgtttaccacgatccaccggaacacctcccagccagttaaacagcaaattaaaagggaaaaagaaccactctttcttaataaggaaaccagcgttacacccgatcgaggtataaaaaagtttccctacaataaaatcccagttactggtatgcggagccacacatacgatacacttcggcaaatccacgccatccaccgggcccagcttccaccccgccatacggagtatcgccttactaattgccttcttcatgcctatttgtccttgctcaactctcctatctcgtcggcgatagcgttaacctcgttttgcaagtcctctcttaatttgcgataataattccgtacgagagccttgttatccttgccgtcggggtgtccggcacgaacgatataactatcttgcatatctaggatacgagccatcaaagcatccgctttctcttgatttactccgggtatatacaatttgcaaaccagcgcttccgtgaacaattcaccagccacgtagctgatctctttctttaaaattcttcttttagccataattatttcatatttaattatccacaaatatagaacatatgttattaaataccgaggaaaggccaagaaaaaacataaaatgaattatctttgcagcggtgaaatcattgattataaacaaatcaaatatgaacgaaatgataaagacgccagagtttctctttgaaagcagctgggaagtctgtaataaagtgggaggtatttataccgtactatcgacaaaagctcatacgcttcaacaaatttttaacgacaaagtaatattcatcggtccggatgtgtgggcaaacacaaccgctcccgattttacggaagacgcatctttgtttgaggattggagaaagcacgccgaggcagtagatcacttgaaagttaaggttggtcgctggaacgtaccgggtaccccccctgttatactggtagatttcaagtcctacttcagtgaacgagacgcctttttctattctatgtgggaaaatttccgagttgactccatccacgcctacggcgattacgatgagtcttgtatcttcgcgtatgcggtcggtaaggtaatagagagtttctatcacttttacaaactggaaaacaagaaagtcgccgccctattcaacgaatggatgttggcgatgggagcactttacattcaaaagcaaatccctgccatagcgacacttttcacgacgcatgccacatcgatcggacgctctatcgccggtaacgacaaagcgttatacgcttatatggacggttacaacggcgatcagatggctaaggagctaaacatggaggccaagcattccgtagagaagcaggccgcccattacgtggattgcttcacgaccgtaagcgatatcacggcccgtgaatgtaaacagttattggataaggcaccggatatcgttaccccgaacggctttgagcccaacttcgtacccgagggtaaggaatacgctaaaaagcggaaggaggcacgtcgtacattaattaatgtagcggagaaattattgggctgctccatcgacccgaacgctttgctggtttccaccagtggccgctatgaatacagaaataaaggtatcgatgtcttcatcgaggcgatgaaccgtgtacgtacgtccggacgcctgcagcgtgaggtcgtcgcctttatcatggtaccggcttgggtacgtgccgcccgtgcggatttaaaagaggcgatcgagcaggacataaagactacctctccgcttcaaatccctttcattacgcactggttgcataatatgccagaagataaggtcttgaattatatcaaccacgccggcttcacgaacgcagcatccgaaaaactaaagatcatattcgttccttgttatttggacggtaaaggaggtattttcaataagacctattatgatatgctgatagggatggacgctaccgtatatccttcctactacgagccgtggggatataccccgctggaaagtatcgctttcggtataccgacgatcacgaccaatctggccggtttcggtatgtgggcgaagaaaacggtatccggagataaccttagcgaaggcgtagaggttattaatcgtacggatttcaattattttgaggtagcggacgctatcatgaactccatcctggctctcagccaaaaggatgctacggacgtcgaggaaatcaaacagcgttgtttcgatctcgctcgaaaagctgaatggagcaagtttatcgactattatctgaccgcattcgatatcgccatgaggcatgccgaggaaagaaatagttaaatattgctcataattaataagataatgctatctttgcactcgtttttagacaaacactttaaacttcacgataatgaaaattaaggcgaataacgcaaacagtcctatttggaaggacgtctactcacattccaagcttccacaacagttggaaccacttaatgagatcgctacgaatctttggtgggtatggaatcatgaaggcgctaaactatttggcaagatcgacaaacaactttggaaatccacagaaggtaaccctgtacagctattgcaaagcctttcacacaaacgtatggaagagatcttagcagataaggagttaatggctgaaatccaaaaggtatacgctgatttcaaagcttatatcaatgtaaaacccgacaagacacaaccgtctgtagcctacttcagcatggagtacggtttgaccaatgtattaaagatttactcaggtggtctgggagtattagccggtgactacttgaaagaggccagcgatagtaatatcgatttatgtgccgtaggtttcttgtatcgttacggatatttcacacagactttgtccatggacggtcagcagatcgccaattacgagccgcaaaatttcaatgccctgccgttgactcaggtattgcagtcgaacggagagccaatggtattggaagttccttatccgggcagaaccgtttacgctcatatctggaaagttagcgtaggtcgtgtacctttgtacttaatggatacggatatacctcagaacagcgaatgggatcgttccatcacgcaccaattatatggtggcgactgggagaaccgtatgaaacaagagtatttgttgggtatcggtggtatcatgatgctgaacaagttaggtatcaagaaacagatttatcactgcaacgagggacacgccgctttgatcaacgctcagcgtttggtagactatatccaaaacgacggcctttcattcaaccaagcgttggaggtagttcgtgcttccgccctctatacggtacacactccggttccggcaggtcacgattactttgacgagggtttgttcggacgttacatgggtgagttccccggcaagttaggtattagctggcaagacttcatcgatatgggacgtgagaacccgggctctaacgagaaattctccatgagcgtattcgccttgaacacttgccaagaggctaacggcgtaagctggttgcacggtaaggtttctcagcgtatgttcgccccggtttggaaaggttacttcccggatgaactgcacgttggttatgtaacgaacggtgtgcacatgccgacttgggccgctacggagatgaagaaattctatgcggataaactaggtaaaaacttattcaaagatcaatctaacagaaaacaatgggaaggaatccagaatgtatccgacgaggaaatctggaatctccgcatgaccttgaagaataaattgatcgattatattcgtgttcaatacaaagatagctggttgaagaaccaaggtgatccttccaaggtggtttctatccttgagaagatcaacccgaatgccttgctgatcggtttcggtcgtcgtttcgctacttacaagcgtgcacacttgttgttcacggacttagaccgtttggctaagatcgttaacaatgagaagttcccgattcagttcgtattcaccggtaaggctcacccggctgatggtggtggtcaaggtttgatcaaacacatcgtagaaatctctcgccgtccggagttcttaggaaagatcatcttcttggagaactacgatatgcgtttggcccgtcgtttgatctccggtgtagacgtatggttgaacacgccgactcgtccgttagaggcttccggtacttccggtgagaaagccgagatgaacggtgtattgaacttctccgttcttgacggttggtggtatgagggttacgtagaaggcgcaggttgggcattgaccgacaagcgtacttatgagaaccagcaataccaagaccaattggatgcggctacgatctaccattgcttggaaactgagatcatcccgacttactacgctaagaacagcaagggttactctccggactggatccaatatatcaagaactctatcgccaagatcgctccggattatacgatgaaacgtatgttggacgattatgaggatcgtttctatcacaaattggctactcgttccgctcatatttccgctaacaactacgagatcgctaagcaattagctgcttggaaagaggaagttgcgcaacattgggatagcttccaagtggaatctttcacttgcgaccaagatttgacggtgaacggcccggttgtaggaaaagaatacaacttcaatttggtaatcgaccgtcatgaactacaaggtatgttaggtgctgaaatggttgtcatgaaggaagatccggagaaacacacgctgtcaccaatcaataccgctcagttcgagttgatgaaggaagaaggctccaagttattcttcaagttaacgaccactccttccgaggctggtaaccataagatgggcttccgtgtatatcctgtaaacaaggagttgcctcaccgtatggacttcgcttatgtacgttggattcagttataatcggcaacaagtaaaacaaataatcaagaaagagggtgcgtcatgcaccctcttttttatgccatacccagctatgctttacagcgactaaaacctatggttatgagccgtaaagcataggttcatatagtccgtgaatacccatgaatcaaaaaaaggaagccgcacgacagcagcttcctttttcaataggatacgaatattttcaagcttagaaagcgtagtccaaacttaatccgaacaccttgttggtgcggctatacacattctgcccaggaagtcccgtgccgcagtagttgtccatcttcttggtataatcgtggtaagttgtccacatatatcccacgttcaaagccattttttcgctcaacatcactttagcaccaaagcccagcgaataagaatcgcaggagaaactaacatcactttggaaattatcagacaaaccataatctgtaatttgagcgccaccgctaatggtcaatctcttgacaacatcccactctataccaaacagatactcattcgtacctctttccagttccttctgctttccaccggccattcccgccttcttgtcatcgaagaagtgatactcaacagaagccttcaacatgggcaaaaaccgataagaagctgccaccgaaagcatggaaggaatatcgttcggcgtatttacaccatgcttataagggccaaccaaatcttccgcactgtcgggataatccaacttcttggtattgttttcgatgttcaagttcgtcttaaactcatatttagctccgaaattgaatttaccatatttgacatcaacacccaaaaccggtgtcaacccccaacctgtctgatcgcaatccaaagccaggttcattaaatccgctccaccaaaattctgttttaattttgcatccagatacccgtcatagtttcctgagaaatagttcatccggcctccggcaaaagcagaaagccaatccgtgatcttgtatgataggccaagttgtagggaataaatatactgttttccgtccatcgcactgttaatagtatacatatccggcgtgacgatgggactttgaccgccagtctttatatatttcgctacactttccttgaagataccggccatagcagccgattcgaacattggcaggccatcgtcaaacgaagccttaccacctccacccgtaatggcaaagaaaccggagatcgtccaatcaccttttttgtaagccgcaaaaacactcggaatcacaggagcggctgcctttcctttgtaatactttttatagggaacgtcgctcactgtcggcaccttattcactgggtcgaaaccattgtatgtactgaaagaggcatcgatatcccgggtctggaaagcactttggatactcacaccaacgcggaaaccgtctgtcggcaaaaaagaaagacccgccgggtttgacaaagcgccgtctatatcaattgcagcacctcgcgaaagtgaccttaaaaaggctgcatgctgattcgtattcgtcaaatatcctccagcgaaagaaaccaaaggcatcatcatcaatgccgcacctaatactacttttttcttcatgttttacttttcttgattacaaaacggtcgcaaagataaatacttttttcaaacactgcacacttttaataaaaatgtgccgcacaaaacagcaaatactgtgcaaacacataagactaattaacaatagaagagccgcaaaggtagtaacgtgaaatcaggtattagttataatcaaaaagaatcatcctaatcagaaaaggatatatacagcaagtactaaagaagatatacttactttacccaaaaagatatactacaagtgccaagtaagtataacttctatttttccgaaataaatcgtatatttgtctctataacttaattctttaaaccgtatagataaaatgaaaagactagcattactcgcggctctcttactgcccctatccatggctttcgcccaacagaacgtaggattcaagaccgataaggtagaaccactcgtgatcaacccagacaatagcgtcactttctatgtagaagccccaaaggcgaagtccgtgtccgtaaaaggagactgggaagccaacgagggcaatggccagatgacgaaagggaaaaacggaatatggagctatacgactcccccactgtcatccgaaatgtacacctatcgtttaaatatagacggtatttataacatcgccccaaacaacccattctcttgccgtgacgtaggcaccttgttcagcctgttctatatcaacgggggaaatggggattattatcaagtacgtgacgtacctcatggcgatgtaacgaccacgtggtatcactcggacatcctcgggaccgaacgtaggcttagcgtttatacgcctcctttttacgataagaacatccagtcttatcccgttctgtacctgttacatggcagtggcggcgacgagaacgcttggctggagcttggccgtaccgcccgtatcatggataacttgattgccgaaggcaagatacagccaatgcttgtcgttatgccaaacggcaatcccagtaaacaggccgctcccggcgaaacgcccgataacctgaattacaagccggccatgagcaacagcttccccggttataaggatggctcgtacgagaagagtttcaccgagatcattcatttcatcgataaccgttaccgtacgatcccggataagcgacaccgagccatagccggactttcgatgggtggtttccatacattatatatatcattgaattatccggactattttaactatataggacttttctccgctgggctcagcgcaaatggtgtagaccccaatagcccgatgtacacgaacctcgacgagaagttaggaaacctcaagagatccggttatcaattgttctggatcggtatcggaaagaccgatttcttatacgacgcgaaccagcaattccgccagcgaatggatagcctaggtatgaaataccagtacgtagaatccacccgaggacatatctgggccaattggcgggcttatctcctccaattcgctcctatgcttttcaaataaaagacatgagcagatgaatcataatataccgcaatacgacttctataaacacaaatacggcgatgagctacttatcgacgtcgttcccttgaacacgatcaagaagtatctcaaggaacaacccgtacatatattgacgtattacgatataacattgatcactagcggggagggagaattccttatcgatcatcaagcgaaccgggtaaagcctcaagatattatctttacccggcccggcgaaatacgcaaatgggacgataaaacgatacaagacggattcgctcttatctttgaggaagagttcctgctctcttttttcaatgatccggcatttctccggaacctctcttatttccatacggaaagacggtcttccaagctcagtctcgacaagaaagcctatggccgcatctccgagttgatctcggagatcgataaagagatcaaggactatcagtcgaaagacaaacacttgctccgggccttgttgtacgagacattaatgttgctcaacaggttatattctaactcgaacgctttaccaccagacacaaacgcccgatctaaaagtatctatgtagaacgatttatcgagttagtaaaccattccttcaagcgagatcattccatccggagctatgccgatcagctttgcatcaccccgaactacctgaatgagatcgtgaaaaacgctacgggcatcaacgctaaacaatacatcctaaacaaaatactaatcgagagcaaacggctattgacttatacagacttgcctatatccgccataacggaagctctaggttacgaggatccatcctatttcatccgtctatttcgttcccaaacaaacatgaccccgctaaactatcgcaggaatacaaaaccgtaaaaagtactatttcctcctttatacgtattatacgaactccattcgatatgtctaattttgcctctatcaataaataaagcatcatgagacaatacaaatcatggatagcggctctcatattaggaagcacgttatccgctaacgcacaacaaaagaatatggagaacaaaacattaaacgagaacatcccggagatgatcatctcccttgaaaaagaggctctagcctcgaccgacccgatggcattcgtagagctttcagacaccgacgtgatttacttcgatccttccctagagacgaaaatagagggattggaacaactgcgcacttattataaaggtatgcaacttcctccggcagatcatttcgacatgatccgcccggtcgtacaagtcgcgcaaaacatagcggtcctcaccttcaaccttgatagctacttatccgacaaggtaataaaatggaactgcaccgaggtttacagacgcaaccccgacaaccaatggaagatcatacaaacccactggtcttacgtgaaaccgctagattaaagttaaaacatttgccgctttctgaaccaaaacggttcgtaaaatgtattatatagactattcactaaacacaaattatatgatacggaatttactgaaagcggcaaatgcgcttacatttagcacgatgttcctgttactcctcgccggatgcaacaagaacacgattatttttgaggatggaactaccccgaacgactcttcgggaaacgaggatccgggaaacagcacgttggtgaccttcaacgcctccgtggagggccggaacctattacgttccatgtctcccatgaataaagggatacaaagcagggtttatgtcttcgacagcagcgcaggaaccaagggaagccccgaggcgtcaggtctttacataacctcatctcccggggtgttaacaggaagtgacggatataaaatgtttctctccaatggcacttataatttctacgccgtatccgacaatttctccacgatccccccgacattcacgagtggcgtatccgaacccctcttcaacggtatcgattatctttggtggagcgccatacaacaggatgttaatagctcccaaatcaatataccgattgtttatgggcatgtggctacccaagtcgtagtagaattaaccggcggtgaaggtatcacgatcaaccaattggtctccgccatgatcacacctcccgaaaccggggcgaccatggatctgggcacaggtatcatcactcccgccaccgctttcgggaaagcggataagatggggataaacggattaacagcccaatatatcatgttgccgataagacatacggctcccatgactctcacgctggaaatatccgccgacaatgaaaacagtacccgcacctataccacccagatccctcttccggatggcgagttgaaagcgggaaactcttatttatttaaagcggtaatcaacggtaattcggtcactttggccagtgtcaacgtaaaagattggacagatgtggacgagacaggaaagcccctttatccgacccagaattaaagcccggttcctattttccgtatcaatgaatattggtacggaaaatatgcctatatttaccccgtcacctctaaaaacaatacgaatatgattgagattcccgaatccgccaccattggcaaacaggctagcgaaacgctaaagggtaaacggatagcgcatgttatcgagtcgaacagtcctcaccgtttcacgttctataatggcgatccggcggaatactccaataggctggtaggacgaacggtcctaggcgcccaaggctatggcgcattcgtggacatccttatggacgcggatactcacctcttaatcggagacggaaccaatatgcgttattatacctccgcggaaaaggccccgaagaaatatcagcttatgatcgtattcgaggacgactcgttcctagctttcacggtttcgatgtatggttccatctacgctttcaaaggcgagtttgacaatccctattaccaaggtagcatccataagctatgtccgttggacgagagattcgataaagcctattttatcagtctcatcccgaatctcaagaaagatatatccgcaaaggcgttactcgccaccgagcaacgtattccgggtctggggaacggagtctgccaagatatcttgttcaatgcccggatctcccccaaacgaaaaatatcgactttatcagaagaggatatagaccgcctcttcaacaccgtgaaatccacgctggaagagatgactcgccgaggaggccgggatacggagaaggatctatacggcgccttaggcaattaccgcacgatcctatcgaagaacacctaccatgacccttgctccatctgcggcgaacggatacagaaagaggcttacctcggaggcagcatttattattgcccgcattgccagcgagaaagataagtaatacgttcaaattgacaatatgacaatatgtaatctgaagccccggagaatcgttttttccgggcaaaggtacatgcagttaccaaatacgagaaaaaatatcagcaatcaattgtattatagtactttgcttaaatataccctttcattctagcgagattaattcatcctatctcatatttatgcaggagaaaggtgcttttcatacggatgcgtcgcccatttctataggttgcgtacccaattcctaccgtatgtatcgcctaacacatacggtagcgttgcctaacactggcttttgcgttacctaatcccattactttcgtctcctaatagagatattcatacaaaaaaacagggtaaaatggataatttgcccataaagcactccctatttcttctattcgcaaaaaggccctgtcatcataatcccgaattttcaaacaaaacgtcaaggttatcgcattttcgcttacaacatcattgaagcctaccgcaaaacagattgccgccccctgcttttgcgagtgttttacaaacatagagttttgcaggtgagccgtcattcttgataagtgaggaaaaagaaaaagccctgtaatctttaaattacagagctttactttattttgctttctttgaaagcggtccggacgggactcgaacccgcgaccccatgcgtgacaggcatgtattctaagttcttcggagactaaggtgtttcataaatactatctaatgtatttaaataaaaaagagtatctaattaaagatactctttagatatatatgaatagagtgacctattttgatttttataggcttttcggaggatataatgcgtcccaccactccggttgatctttcaaccacttagcgaaccatgcgtaaattgtgttattccacaagatacgtttgtcgtaatccagtatatggtggttctctccttctacctggacaaacgctgtaggcttacccaataattttaatgcggtaaacatctggatgctctctccaatcggaacattcgtgtctgcggttccatgtaagaacaagatcggggtattgatcttgtctgcgttaaatagcggactttgtaaagtgtacatatcccgggcattccatggataactgttagcgctagccaacgagctgtatgaatatccccagtaaccttctccccaatagctggtgatgtcgctgattcccgcatgagacatggccgccgcgaatatatctgtttttgtttgtaggtattgagtcatgaaacctccgtatgaagcccccatgcaaccgattttcttcgtgttgacaaaaggatgctgctcacagaactttttcgtgccttcgatgatctcgtcagcggtaagtttaccccatgcgttgacatggcgtgcggagaactcttgaccgaacccagtcgctccactgggttgtatgatgtagacgatgtaccctaagccggcgtatacatgcgaaggataacggctttccatcacccgggccgtaggggttgttcctccgtaataattcacgatcatcggatatttcttggtcgcatcaaaatgaggagggagatagaagcggccgtaaatcgtatccccttgggcggaaacgaaattccaatcttgcacttctcctaaagtgacgtctctcaagatctctttggagagatcgatcaagcaggaagaggcgtcgtttttcaagttataggtataaagcctttgggaattggaagcgcttaatccgaaataaaccatttcgaaagcttgattggcgatggagtaatcggagatgacatcttccttggcttgaagttgcttaatctttccgttggacgggtttagactatacatgcgaacacggcccttatctttcgccgtgatatagatttgtttatcgagggcgttccactcgtaggaatcgacagaggggtcaaaatctttcgtaagcggctttatacttttatctgctatattgtataggaataattgcccgtcgctcgtattcgatgtctgtccttctttgatctttaatccgataccatcgaaagcctctccagacgcgtcaacgagtaattgggtggcatccggggagaaaacggcacggcttacgaatttctcaccttttataagggtatccacatgcatggttcgtagatccatcttatatatatatgtacgtgagaaagggcgctccgttaaattcggttccctacgactgaatagcagatagtggccgtcttgagatacatcgttgatgtaagtagaagtatgtccataggtgagccgttggaacaatccggttcgcaggtcatatttatggataaacatacggtttctccatcccggttggcgatcatccggcaccagtatctcttggatctcttttcgttcttgcggtcctttctcccgtatggagaataatagatagtcctcggtaggcccgaagctgaaagaaccttcaggcaattggcaggcaaggatgttctcctttttactggtagggtctaaggtcaccaattccgtgcctttcatccctttccttgtgtaataggccagattgcttttaggcatccagcgtaagctctgtccgttctcaaccaatacggaaccggtagccttgtctagtatctgggtaaatgaggactgctttccgccgggataggtttcttgataggagacgataatgaattttccattcggggacaggctggcggattggatgcgtttaccatcaaatacatcacttaatgtataacgtttctccggattgacggtcgcggttaccaccgcgtctttttccgggttgaatgaggcttttaaggcattctctttgtggctctcagataaatatttaattacgatttcatagcgtcgcggctccaaggtcaacgaggcttctccttgggttagttttatgggttgtccatccacgtagacttctgaaatctcagggccattgatccttaaggtgccttttgtatagcggtcactattcaggtagaaggaaaccaaatgtagcgcgtaggaagaggccgaggttggcaagatcagctctccggaagacgccgcatcaagggtttgtccgctttgggaaaggttgcagaaaggaacggtcgtgttcaatagttccttgtcagagaatctcttactgtttacatccaggctatctgccaagaagggtttcttcacctcgtaagggccggcgtaattataatgtcgcacgacaacctcatccgcccatagtgagcaacaggagcatagggctgaaagaattaagatgtttttgtttatcatgatatttgttatttagtataagatttctatctcatctacgaacaagaatgcgggacttccggcgccaccgtgccattttggtagtttgctgctgttgatgataatctcgacatagcgggcctttaccggggcgaaggatatctcttggggatataaaccgtccttgtcgttttgggttagctccgggattttcttggaagctacttccttgaaattcttgccatcgtcggatacctttacggttacggcggaggctcccatgatccaatcgccttttaccacattcgtattgaaagataccttttggatttcggttggttcctttagatcgatcgtggcgtcaaggtcttttccttggaaacccagccaatggccggtcttgtaattgcttcctccacgtaagccgtctaccaatacctgtgccccgttgaaaacgtatcctttgctgggttgctctttcaaggtgatgggcttcatcgtcgctttattgaagaagatatcttctgagaagatgcggctcgtaccgttcggacggacaacgatcgccttgaattcgcaatcttggttgatctgtaccgggccttcatacttgatgctggcgatcgtaggatcgctaccgtctaccgtataatagatatctccttcacccaacttcgtcaaggctatgtcgagtgttccgttctccgtattggtggtcagggaggcgttaatatcgaagatatgctttccgtaattatatcccaagcgatcgtaaagttgtgtcatgcgggccacacggggcaggaacgtctgataatctttcttggacggatcgctccactggatatcggctacggcgtcgatacggggcatgatcatgtattctacctgtgagaaggtcgggatatattccgtccagaggttggcttgcgccccgatcacgtacttctggtcttcaggagagataccggctgtcggctcaaaagaatatactttctctaacggcaagtaaccaccgatagcttcgggctcaagatccgtatccgctgattgatagtaatccagatatacatatgtattcggtgtcatgactacgttatgcttttgcttggcggcctcgatacctccatccatgcctctccagctcattaccgtggcattcggggccaagcctccttctaggatctcgtcccagccgatgatatggcgtcctttgctctccacgaatttctccatgcgggagatcacgtagctttgcaaatattcctcggcggaatgtttcttgtcccccttgataccttccgccttgatgcgagcttggcatttcgggcatttctcccaacgtaccttcgggcactcatcaccacctacatggatatattcggacgggaaaagatcgatgacctcgctcaatacgtcttctaggaattgcatggatttctcgtttccggcgcagatcacgtcgtcggctactccccattggccccatacgtcataagggcccccggtgcatcccagttccgggtaagtagccaaggctgccaattgatgtcccggcatatcgatttccgggatgatcgtgatatggcgttcagcggcatagttgatgacatcgcgaatctggtcttgtgtatagaagcccccgtattcctttccgtcatatgttccggagttatggccgatcacggtttccttgcgtttagatccgatctgtgtcaattccggatatttcttgatctcgatacgccaaccttggtcatcggacagatgccagtggaacgtattttggttgtgcaaggcaaggatatcgagatacgtttttaccgaatccacggggaagaaatggcggctgacatccagcatcatgcctctataggcaaaacggggatagtcgttgatggtagctgccggtaattctacgttcatcccttgggccgtggccgggatcgatttacgtaatgtctggataccataaaatacgccggcatccgtacttccggcgatccgtatcccgttatcgctaacggtcagttgatatccttccggattctggatactttggtcgataacgaggctgatccccttaccgggctggccggtagcggttgctaattcatagcccgtgatttccttgatataagaagcgaggaactcggcgttcttcttcatcttatcattgccctccggataaaatatcttcgtggatggacttaggacgaaaggatttccgttcgtcaatgttacttcttgtggcaaaggcactactccgtaatctccttttacggccttaccaccggagcaagcgatcattcccgtgcaaaatgtcaggacgagcgctagtttgcttaggctgttcatgtgtttagagtttagaatgtaaaacaataattgattcagtatcaccgcccaaagataaatagaattagccgttttatctaatgcttttacacttttgatgcgataactttagggattttgtctatatatatagactatttatcaactggtgcatgatcgtccaccagctgttgcatgatcatccaacagttggtagacgatcatgcaacggctggtggatgatgaatacttctataagaaatgtctaaggaatatggaagaaacacctaaggtctaaagggaaaagggctagggactaagggaaaagaaacgtcttcttgagaggtatttccttgtctttcttataataagaattcacacgttttacggttgtgcagcggatgtaagcgtcatggcagtagatgagcgcttgccttttttcggcggcttcggcaagcatgcgcagtttctcgttgtatgacgtgaccggatacgtgtcgtaagcggagatccattccggggatacgctggctacaagggggataacatctccggcaaagacaaaagtccgatcttccgtatggatatagggaacaatttgccccggagtgtgcccatcatacaagcgtagctctatcgtggggcaaatcgaagtgtcggcatctagcagccgtaaggaattagcatccgcgacggcttgcatattctcgataaaataggaatctttctccaaggcgttcggatgaaggaaattctcccattgcttgcggctaacccagtggttcgcatttgggaatgagagaaataaatgtccggtagattcatccttttgcgtggtataaccgcaatgatcgaaatggagatgggtgaggacaacatccgtgatttcctccggttgaattccccggtttcgtagttccgtgccgaggtctaccaagttgaagaagcggtaataacttagttgttttaagtgtttatttcccgctccgttatctactaggacgatgcgtccgtcatctgtttttatgacaaggctacgcatggcgagcacgcaaccatttgtctcgtcgctcggatagcgacggctccaagcgcttttaggaatggccccgaacatggcgcctccgtcggcgtagaagtagccggtatcgatgatttgtagtttcatggtttctgcattctttctttgggggagtaaaggtatggtttttatcatactcaatagtataataaatgtgaaaatgactggtttaaacgttgtctctacaactgggtaataatcatttcctatcttttacgctacttcccaagtagccgatcgcctaccccacctttgatacattattatatatgctctcgaagcaagccttgttcaccgcagacatcttatccaaagagaagctcttcaaatagatttgcgtcgtcttgatcgattggtgtcccagcaattcgctgatcatctcgatcggtacaccctgttccttcaaggtcgtggcgaaagagtgacggattgagtacgaggtaaccatttccgtcacaccacaggcatttgccagttccttcaaggaactgttgaaatcagccaaggcagaggtatattcccggaaggcctcttcacccgttttcgtcccactcaagaaagtgaatagataaggagaatccctaagcgtgtcggtcattaacgcagccaacaactccttggccacaggctgtatctcgaccaacatcggtgtacccgtcttctggcggttatacctcaagacaccattccggatatcactctttttcaaatgagcgaaatcgacaaacgccataccgcaaaacaagaacatcaaacacaatgcccgctgtgttttccgcagccccgaatcatccaacggagcggtcatcaacaaacgcaaggattccgtaggcaacgccttcttctgtttgcttttcactcccatgaaaattcccttgaacaaataacgggaaaaaggagcctccccattctccatcgccaacccatacacacggcgaatcctacgcatataggtagacaccgtattccacgagcattcccggtcccgcaaatagtcttgatacctcaaaagcatttcccggtcgatacgggtataaggaatcacctcctgcccacaaaaacgcaggaatgaattcaaggcatcttgataactcttggcggacgaataacgtccttgctctctcaatcgggctatatacatccgcataccctccgctaaatcatactgtttcatattttcacgtataaaaaaagtaaattacaataaaaaacacggttaattcgtgattgtctacttacatttgcagaaaaacaaatactatggacaagatcgtagaaatagcccggttcacctatccggcggatgcccaaccgctgatggccctgttgaggtcggaagggatagaatgttatctccgcaatgagttaagcagccagatcatggccggttacgtagacgtaggcggcgcacgggtggagattctggaaagcgacgttccccgagccatgaagatcatggaggaaggcggttacgacctgccccgggaagacgagcaagcggaaccggtagaacaagtcgccggattcgcacgtcatatcccttttctacgaaaatatcccttagagaaacaaatcatgatcctattcgtcatcatagctgtctttttggctttggtgatttacttcggatcgcttatttcctcaaactaaacaaatgtaatcaatggcacgcagaaagataacaaatagtcaagccgtatgtatcaccttactatggggtgtcttatgctacatgctgcttgtatacagcgaaacgatcaatttcgacgtcatatttgcccttgtagcctccgctatcattgtgttcgttccgatctataagaatttcaagcatagagatgaataacatttcgtcgttttttcaaacttaatatatctaaatgatattttttacgcattttctctttcaattatttgctagtgtcaaaaattagcttacctttgccacgtcgttaaacaaacggcgtacggataacaaaatggtataacattctaaatataaaattcagtcatgaaggcaagtgaagttttagacaacttgaaaagaagatttccgaacgaaccggaatatcatcaagcagtatcagaggttttagggactatcgaggaagcttacaacgagcatccggaatttgagaaaagcaacttgatcgagcgcctttgtatccccgatcgcattttctctttccgtgtaacttggatggacgataagggacaaatccagacgaacatgggttaccgtatccagcacaacaacgctatcggcccgtacaaaggcggtatccgtttccacgcttccgtaaaccaatcgatccttaagttcttggcttttgagcaaacgtttaaaaattcactgactacattgccgatgggtggtggtaaaggaggttccgactttagcccgagaggaaagtcaaacgctgagatcatgcgtttctgccaagccttcatccttgagttatggcaccatatcggtccggacacggatgttcccgccggcgatatcggtgtaggcggacgtgaggtcgcttatatgtatggaatgtacaagaaattggctcgtgagaatacgggtacattcacgggtaagggtatcgagttcggaggttccttgatccgtccggaagctacaggttacggaaacgtatatttcttgttgcagatgctgaaaacccgcaacattgatatcaaagacaaggtagtttgtgtatcaggttccggaaacgtggctcaatatacggtagagaaattaatcagtcttggagcgaaagttgtcacgatgtctgattccgacggttatatctatgatccggatggtatcgaccgtgagaaactggattatatcatggagttgaagaacttgtatcgtggccgtatccgtgaatacgcggagcaatacggatgcaaatatgtacaaggcgctcgtccttggggagagaaatgcgacatcgctatgccgagcgcaacccagaatgagttgaacggcgacgatgccaagactttattggccaacggttgcttcgccgtatccgagggtgctaacatgccttctacaccagaagctatcgacgcattccttgaggccaagatcctttacgctccgggtaaggccgctaacgcaggtggtgtatccgtttccggtcttgagatgactcagaacgcacagaagttaagctggagcagcgaggaagtagaccagaaacttcaaagcatcatggaaaacatccacgagcaatgcgtaaaatacggaaagcaagaggatggttacgtaaactacgtgaaaggcgccaacgtagccggcttcatgaaggtagctaaggctatgatggcacaaggaatactctaggtaattgaaaattgagaattagttagagagaagcgattgatgatcatataagcgagggggataggctttgagaggctattcccctttcttatttccgacgaagtcccaattttcaattttcaattcttaattttcaattaaaaagcggtatcttagtgccgtaaatcgacaagtatgataacagaaggacttaggaagctataccaatcatataccggatcaccggcagaggaaataacggagttaccgtcatccggctctaaccgccggtatttcaggataaaaggtcctgagacgttgattggagttagtggcacttctattgaggagaacgaggcttttatctatatggcaaaacatttccgggggaagggcttacccgtaccgcaagtatatgccagctcggacgaccattcattttatatccaagaggatttaggagatacgcttcttttcaacgccatcgagaaaggccgtaaaagcagtgtattcgacgaggaggaacgccgtttattacacaagacgatcaccaaactccccgacatccagttcttggggtccgacggtttcgatttctcgtattgccatccacaagccgagttcaaccaacggtctatcctttgggacttgaattatttcaagtactgtttcctaaaggctaccgggatggagtttcaggaaaatcgtctggaggatgatttcttgaagatgagcgacgtattgttacgcagttcctccgccacgttcctataccgtgatttccagtcacgcaatgttatggtaaaggatggagagccttggttcattgattttcaaggtggacgaaaaggcccggtttattacgacgtggcttccttcctttggcaggcgaaagcgaaatatccggaggatctgaggaatgaattactatcggattatatcacggccctacgtaaatatatcccggtagacgaggcttacttccatagccagctgcgccatttcgtcctgtttaggaccttgcaggtattgggggcttatggtttccgggggtatttcgagaaaaagcctcatttcatccaaagcgtcccgttcgcgatcgagaacctgcggcagttattgaagaatgactatccggaatatccctatttatgctccgtccttcgtgagcttaccgggttgaaacaattcacggatgatatccagaaacatatgctggaagtaaaggtcatgagcttcgcctataaaaaaggaatcccgaacgaccctagcgggaacggaggtggattcgtattcgattgccgtgcgataaataaccccggtaaatacgagcgttacaaccatttcaccggtttggatgagccagtgatccagttcttggaggatgacggggagatcacgaacttcctcgagcatgtctaccatatcgtagacgcctcggtaaaacgatatatggatcgtggattcaccaatttaatgatttgtttcggatgtacgggaggacagcaccgttcggtctattccgcacaacatctggcggaacatcttaacaccaagttcggagtaaaagtacatttagtacatagagaacaaaatatagaacaactctttaaccctacattatgaaagctatgattttcgcggccggtactggttccagactgaagccgttaaccgatcacacgccaaaagcgcttatacctatcgggggtaaaccgatgctagaacacgtcatactgaaactgaaatcctccggtttcgaccagatcgtgatcaatatccaccatttaggcaaccagatcgtggattttctggaggcgaacaacaacttcggtgtccggatcgaaatctcggacgagagcgattatctgctggacacgggaggaggaatcaagaaggccacttctcttttatgcgggaacgagcctttcttgatacataatgtcgatatcttatcgaacgtggatctcaagaaactatacgatacccatgtacaaacgaacccgttggctaccttactcgtcagccagcgcaatacctcacgttatctattatttaataaggagaatagactgtgtggttggcgtaatcatgagaccggcgaggtaaaatcttactatccctattttgacccggatcaacacaacgagtacgcctttagcggaatccacgtactctcgcccaagatattggagctgatggaagaatggaccggaaagttctctatcattaacttctatctggctatttgcgccaaaaccgatatcagggcttatatggcggataacctaaaactattggatatcggcaagccggaaaccttggccgccgccgaggaatggctacgaacattataaaacagtacaataggcattataagcctctaacgatgggcattataaagggctaacaactgcgatcgttagcaccttacaatgcctattgttattttctcaagatttcagcaccacgccaagacttttcttcccatccatcttaatcgtaatcggagcatcaaaacgtacatgacgaagatattccgtctcctctacggcaggttgcgcattcaagaacgcctcatcgaaccaaccatctcccttaaatggattaaccgtaaaatagcccactccgaacgaagtcaggttctggaagaaatgggtaccttgactcgggtctacccgataattctccaatccgcattccacgatcacccgtgcgttactgatatgcggccatttcaccgggatacccaaccaagagtcgctgctcccccatcggccggggccgactaatacgtatcctttctcctgatcggtgaacgaacggttcatcttctcgatctcataagcgatcaactgattattggatgaattaaaagcgcccgtcttcacatagataatatcctgtacgtcgccaacgataccatgccccaaaacactggtagaagaaaggatggtttcctcgttcttcaccaagctcagatcctcgtccataatctctttattatctacgatcggacggatttgcaacagatagaaagtcgcccttgtatgatccgacgggtccatgttgacagcgaactcaatctctaccggacggcccatttcctgctgcccgatccgtaagatctgatccaacgtatccgccagcgggaacacgtcatgctgtaggatattcacgaaagaaaggatcttacgaccgcccggataataaccgtcacggataatctgatcgtacggatcgtatgtagagacaatatatttcaaggaaccttcagcgtcagcgtccttcaagcccagcttcaccaagttaaaggcatcatctaccgagaaggcttccgccatattcttcaaatccaaggcatagaaacgagtctgagtctccctaagagcgaaatccatcgtactcatctgcaagatgctatggggatgtcggggagagaaacgcaaggtttgcccgccatcgacgatatacttacccaatcccaaggcgatattcgcgatcccatcttccgccttctcgttaccgatcggatagaaattcaaggaacgggccacgcccgacatcgtcggatagaaatgatcattataacgggagcccaccacttcttgcaagacgatagccatcttctcctgatcgatcaagttcgaggtagccgtcatatacgccttactatccttataaaagacagaggcatacaccgccttgatagcgtcgctcaccgtacggagcatatcgtatttctcctcgatcttaggtaccatatacgtagaatagatcccggcgaaaggttgataatgcgaatcttccagcaggctggaggaacgcacggcgatcgggcttttcaccacatcgaagaaagccatcaagtcctcgattaaacgggagggcaagctggcccgcaagaaataccggaggatcgtctcgtcgtccgcatcgcccagcgctaccggatacaactcgttcgtctccatgaactcgtcgaagatatcggtacagatcacgaccgtcttcgggatattcacagcaaaattatcactctccagcttagggtatcgcttcaccatcgcaccgataaaagcaagacctctacccttacctcccagcgaaccgtcgccgatacgggcaaaattactatactcatcaaaacgatccttctgataaaccgccacgacacccgtgttcttcatccggcgatattgcacgatcaagtcgaaaatcaatttccgggcctcatccatatccttatagtcactcacgtccacatgcttcaaaacctcggcgggcggaaacatggcacgggaataaaagaaacgggagaaatgattccgggagagatggtaaaccagcgagtcgtcgggaatctgaaagactttcttttgaaggtctttcaaatccttgatgcgcatgatctcctctttcgtatgcggattcaagatcacgaaatcgccgaaaccgaaacgctgcatgatcttctttttcaaatcctgcggataactcttggaattcttatcgataaacgaggcgttcagttccttcgcgtacacatggttgctggcctccgaagattccagcacgaaaggaatgatcaaacccgttttccgaacatactgtccgaacttataaccggcatacggatctttcacgccattgtgcataaaactcatatccgagataatacccaacatattatcccgatactgatcaaaaatacgtaccgcctcctcgtaattccgggccaatttgatcttcggacgaccccgcatacgcaacgtacgctggtgatcgttcaacgcctccttcgcgaacatttggctctgctccaacacgaacttatataaatgaggcaaagcggacgaatagaaacgaatggaatcctccaccaacaagatgatctgtacgcccacgctggccgtatcgtccggagcgttcatcttatcctcgatcaacttgataatcgccagtaacaactccgagttacccaaccagctgaacacataatcgatagcgctcagatcctcgttggcgatccgcttagacacctctttcgagaaaggagtcaatacaacgatcgggatattcggataatgcacctttatctcgctcgccgcagcgaatatatcccggttatccatattcggcatgcaaatgatcaattcgaagttccggttcttcaactcattcaaagcctcctcctcggtagtcacctgcgtaaaccgtggtgggtaacggaggcttaaggaagtatattcgttaaatatctgctcatctacacgcccgtcatcttccagcatgaaggaatcatatttcgtagcgataagcaatacattatatatacgcttattcattagattggcaaacggggtgtctctgaacaccaagtcttttaagttcggtataccgctcataatagattctgatagaattattcgagtcaaatgtaaggaaaaataataactattgaaacatgaaagtacgcattctgactctaactgaagatttttaggttttcactgataaaaagtaagcgaaactcttggtcattccaaagaattacctacatttgccaacagaatgttatccttttaaagaatataaatgctatgaagactgaagttattttatcagcgctagaggcaaaacatccgggagaaaaggagtatttgcaagcagtaaaagaagtgcttttatcaattgaggaagtgtacaaccaacatccggaatttgagaaagcgaaaatcattgaacgcctagttgagccggaacgtattttcactttccgtgtgccttgggtagatgataaaggtgagatacaagttaacttgggataccgtgttcagttcaacaacgcaatcggcccgtacaagggaggtatccgtttccacccgtccgttaacttgtctatcttgaaattcttaggattcgagcaaacatttaaaaacgctttgacaacccttccgatgggtggtggcaaaggtggttccgatttcgctccgagaggaaagagcgatgccgagatcatgcgtttctgccaagcgtttattcttgaattatggcgtaatcttggtccggacagggatgttccggctggcgatataggcgtaggtggccgtgaggttggttatatgtacggtatgtacaagaaattggctcgcgagaacacaggtacgttcacgggtaagggcatggagttcggaggttctatccttcgtccggaagctaccggcttcggcgctctttatttcgtacatcaaatgttggagactcacggaatcgatatcaaggacaagacggtcgccatctccggtttcggcaacgtggcttggggtgccgctacaaaggcaaccgagttgggcgctaaagtggttactatctccggtcctgacggatatatctatgatccggcgggtatctccggcgagaagatcgactatatgttggaattgcgtaattccggaaatgatatcgtagctccttacgcagacgaattcccgggctctaccttctatcccggcaagaaaccttgggaacaaaaagtagatatagccttgccatgcgctacccagaatgagttgaacgaggctgacgctcgtaagttgatcgagaacaagactttgtgcgtagctgaggtttctaacatgggttgtacggctgaggctgtagacttgttcatcgagcataagcagttattcgctccgggtaaggctgtcaacgccggtggtgtggctacttccggattggagatgacccagaacgctatgcatatctcatggaccgccgccgaggtagacgctaaattacatcagatcatgagcgcaatccacgaacaatgcgtagctcatggtaaggatggtaaatatatcaattatgtaaaaggcgcaaatatcgcaggcttcatgaaagtagcgaaagctatgatggctcaaggtatcgtataagaataaggtcagtttaggctaaataaaaacatagttatgaattctttgaaccttagttatggtttgagaatttcataactatgttttttaagctcatatcagcggactttcccggggttcttagcgataaaatccttccatcccgtatacttcttttccgagatcggattattggtttggaaataatgacaaacagccgccgccaatccatccgtagcgtccaattgcggaagcatagactcatccggtatcctcagatagcgttgtagcatgccggccacttgttctttcgccgcatttccattcccagtgatcgagagcttgatttttagaggagcgtactcgaagatcgggatatcccgctctaaagccgccgccatcgctactccttgtgcccttccgagtttcaacatactctgtacgttcttcccgaagaaaggcgcctcgatagccaactcatccggatggtattgatcgatcaaggccaagacccgttcgaatatcttacgcagacggaggtaatgatcctcatatttattcaattgcaggattcccatagcttccagcatcggcttatttccctcgatcttcaagattccgtatcccatcacgatcgtaccggggtctatgcctaatataatacggtccttgatcatttaggcaactctatatcttccaacagggtagagaatcctgcgattttctctttataacgtcctatcaaatcttgctgcaaggctccgccttccttacgcacccactcattcaacgaatcgatatccctcgtataaaactgtacggaaaaactttcaccttcctcattccgcgaatccaagatccgtctcaaataaggactataaaggataccgctctcggaggctttcggtatataactattcttcaaatattccagacactcatccacgatatccttatggatatgaaaagtcgtattataaactatcatcttctttcctttctcttgaaatttcttatacaaagatagcgcatatatcaagaaaagccttatatttgcacataattaatgaatggggcattagctcatctggctagagcgacagactggcagtctgtaggtgatcggttcgagtccgatatgctccactttacatactgacaaacaagtaattaaataagaaggggactaaaatcataatagccctttaataacttatcatcttatcaaaatcatcaagagtctgaatccgtagtcatggaaacttcttggactctctatttgtcatcgcttgaattcaccttgcactatcaggactcccatcttttttaccatgaaaggggcctaccttattaaagaaataagcacggacttcaggatcgagccttaaccgtgactcggctccttctacgggattataatatgcagcaaaagcttccgcaaaccattcacatggagcagaaaattgataattagaaacggcatacatacgtgcagaacttaaaaaactaacccattcgccatatccatctctcatgtaaacacatgcacctacttttaaatctttttcacaacaatcattaaacatccacggttgattctctgctatttcaattgatcttttgcatttatccaacttttttttcaatgagttttttttgataaattttaatagacatgaattattcaattcatccccctctataaacttcattaaagcaagaaaacaatctattcgtctcaatttataaactcgatcttctggttcttcttcccccaataattttccttccccaaatgaattcaagatccagcgttgcttctccttccttgtttctttctcatctctcatatttattagttccatattttttttcaaacaattcatttttccttctatatgtttaaacctaacgtaatactctaaatccgggtcttttagataatctccaaaaacaagcaataatttcgaacgaaatgacgaagaattacctttatcttgtacccaaatcttacggttacgcatatcgtacatatccctatttgcaaactttctaaaaacgtaatatttgttatatttcctccacgcaccaaacatgctttcatgagaacaggtattttcccatcctaactttttgtctacagaatgccctatctcatgacgaatagtccaatccaataagagttcttgagaattagcatctgagacaccagccataatttttctatctttacttttgaggccatatttcttatctgtcttcgtattgtagtcatatccagatcctctatccatgatgtctctcagaacctctaaactcttgcctagagacgaatacaataaatctgatatattcatgggattatgtatacctaaagtctccttttcataatcataaagactggcattccctaccccttccgtattgatctcttttaatttaggattcgactttgtacttgactccggtaaaatagacaatacataattaatcttttccaggatgggaccaccgatatccggggatacatcgatattataatttcttcttatttcttgtcgtaatctacgatcattagccatacatttattgctatgttgagtgccaatcatcctacccgctcttacaccaagagccgcaccttctatagccccgtcacttccacccacaattgcacctgtaaccccagcaacagcgccaaatattatagaagccatggctggtccataatattttactaaccccttgaaaaaatctccaaaaccacactgaataacagccgtttttagttgataagggctattttgtgctataggctccctatatggtgacctttgaagtgaagcgatcaaggacgcttgttctaaattacaggatctattatcaacaatgttccttccaccacctcttgactgctgtattacccgggaagtaccctctttgtgttgtctctccactttcatggtcattcgatttaaggatttaaactattctttctcttctgcctctttatctggatcaagccccacttcttttataaatttagcggttgtctccgcttgttctgcttgagcctccacgcaggctttcaacgggcctccgataattgagctaaaaggaatacgcagcacttcggttgcggtctgtgggggtgtaggatctttaccatggtgattacttttaaggatttcccaaatatagggaattatttcggaagggaggatagaaagggagagaaaaaacgcctacctaaaaattggtagacatctttatagtaagtcttcttaaaaatcatatctcaatatttgggggcatgcttatcaacatcagcaatatcaatattatgctcttcaaagtatctatccctcaccagcaccgctattatcttcatatacgaagattgcgcattttcttccacaagaatctaatttcagagaatgagaggtacacggaagatcatctatctgtttggttttgtcatagactccccttacccaccatataagaaaaaagacacaaggcctatttataaagcaccttttccccaatccccatagttcgtatccagtaaattctttaagctcccgacttggtggctgtaataagcaagtaggtctttcgctatctgctttttcctggtcaggatggaaaggaaacgtaaatgggtggtaagtttgccgcagatccacttacgctcctttaccgggatatccgattgcatcaagtaaggcatgcaaatctcatgtaagttcgggatcgccaagtcccaagggacagcggccatcgtccccaaaaagtctacaatctgtttcaactttttataagacatgatcaatatctccttttccgtacgattgggagtacatgcgtccggcattaacaagacggcttctttcaagaagtaatcctttaaattctcatccgatacgtgcaatgcggttttctgttgtagctcaaatccaccaactacctgctggggtgactcttggttgtccatacataatcagtattaatgtgtagtagacggctcttctcggatcaccccgaaaagttgtggagttagaaaaaaaatattagttttgtctcatggaaacaggctacgaactcttattacctgaaggcatactgacctattttgaagtaactcatgccgatcgcacctcaacagcaatattaatctacctggatgagaaggacttatccggggaagaacggagtggaaaacatcttcaatctaagggtttttatcccccagcctctattcatgactttcccttgcgtggtaaaagtctaatacttcatgttcgccgtcgtcgttggctggatcttgataccggcaatccttatatgcgagattgggaggttgtagcaaaaggcactcgtctgaccgaagagtttgcctcttttttaaaaggcacacctggataatacgcccgtcagtagtagcaccttagctaaattttatggattaaacggccaacggttagaagaatggtatcgtttgtatttatccggattttatgaatggaaagacagggaccatgcggataaatggttattattcgaggaaaacatgggtccttatttaagtatagatgaaacctctttgagtgatgatgaactttatacgattgtcactaataaggaggcaaagggtcgtaaagggtccatcgtagcgatagttaggggaacaaaagccgaagatgtcatagaggtgctgttaagaataaaaaagggattacggcataaagtaaaagaagtcactttggatatggctgccaatatgagtgtgatagtgagttgttgttttggcaaagcctcacaagtgacagatcgtttccatgttcaaaagttagcctgcgatgctttacaggatatgaggattgctcttcgttggcaggctattgagcaggagaataaagagatggccctagctaaggagagtgatgaatcctatgtggcccaagtcttagccaatggagatacccatcgtcaactccttattcgaagtcgttatttgttatttaaaaatgaggacaaatggactccgagacagagacaaaggtctgagattctcttttattattatccctctttagaagtggcttacaagctaacgatgcaactgaagcatatttaccatacaaccaatgataaaaaagtcgctcttacccgtctggcaagatggtataatgccatcgaagaatccggctttgaacattttggaacggtgatgcggtctgtacagtcacattataagactatattaaacttctttgaccgcagggcaaccaacgcgtccgcggagtcctttaaggctaaaataaaagcctttagagcgaatcttagaggggtaaacaatattcaatactttttattcagactcaaaaatatttatgcatagctccacaacttttcggggtgatccccgattcactttcttccatatatgataagatgtcaatacttgatgtagcgagtggcagtcccctagctcttctagctggtgccaacactccagatatcgcaggacagactaaaaaaatcattacaaacagctatcagtctcctgtaaatattgtgttcccaacgaatgagataaaggttgtcatttccgataggtggattcaaaacatagcaaaatagttatgtttttatttgatggattataacaaatacgctatatttgtatcgtcttaataaataacggtcttttatatcatgaagtacaatcagtttattgcggaacttaccgcagcaggttgttatgtttcccgtcacggtgctaaccatgatatttggtatagcccaataactggagaattattcccgatcccccgtcatggaggaaaggaggttcccaaagggctggaacgtaaagcaagaaaggtgctcggggtttagccccggcatccttgcttcacaagaaagactgttttattaagcgattggagtcggtatagtgccggctcctttattcacaaaaaaagaaaggtatatgaaagttactgtaatcatggaaaaggcaagcgatgggtattactcatgctttgtagaggaggatctgccggggtttgggctggccggttatggtgataccgcagaggatgcaaaagcagatatgttgaaagcctatgaagatatcaaggaaatgaaagtggctgagggtacagacgttccggagttggaatttacctataaatacgatctgcaatcgttctttaattacttctcatttttgaatgtaacgaaagttgcggaggctgccggcattaatccttcattgatgcgccaatacacatcaggagtaacagcggccggacaaaagcaatatgataaaatacgaatggctgtggaaagaataggcaaagaactatcatctgcaacgttctaggatagtgtaccgccgggaggcgagaccgtttatattaagacaaagttaagcccgttccggttatttccggttcgggctaagtccaagattaaatctcttagtctattaactttttgtctttttaccttatactcaaaaaccagtcgagtccgatatgctccacttctgatctaccctgcgtttattaagcttcttgatataatttcaatggtatatacatccgtcttgtcgaactagacatatcgagaacagtctgatatatgaacccatttttctcataaaacaagtttgtcttcggattatttagtgagtcaactgttataaattgacatctggcaactttataattaaggaaagtgtccatgatgaaattgattataaatgtccctattccttggccttgcatatctctatccttgtagcaagatgtcctatatttatagcagggaaagcggatagatcctcatagccagataacagcttaatagaaaaatcaatatccgagaatcgggttttttcctccattattattcgctacacgctgcatctctcttttacggagttcaatttgttctttctccgtatccgtaaagtcctggacaatacatttacgtattacaccgtggaaacgtataatgtcctcacgtgtcatgtctggatttggaatggaactttgcatgaatgagccttcctatccttttagatatttatcgatacacctacgatcccaattgataccccgtcttacgattttcgcaggaattcccgcaaggatcacattcggctcattaaattccttcgttacgacactgccccagcctacaatactgttatcagatatttttacattcttaccgatcttagcgtcttttccgatccacacatgtttgcctatctctatgtacttcgcaaaattaatcggcgcaccctccaaatccgttatcgtatgcgcatcggtacaccagatatcgacaccccagcttaactgactatcatcaccaatgctgacacgcgagtcattttcctgcaagtataacgtaacgccattgattactacacgatcccctatatctacccggcaattattagcgaccctcgaaacacccgcacccaatcccggcaactgcccaatgatgagctttaatcccgtcatacccaatatcgaagagtatcgtaagataatcgttcccacatttacgatgttattatccccttttacgatcaagagaaagccatcactaagcaataattcctccgccttatcttctgattcaaaacacattgagacctgattattatttcctgcgatcgttatgttggcccgattgacaaccttagcgaatctctcattcggggcagaaatacaattgactctaccatgcgggaaaattaatgtaagctcgttgttctgtccgtttatatgttccatgtcattccatactttataattcgcattctattattgcaatacgactccttgtttcacttcccaaatatacgaaaagaaatgattcacgccgagaaaagcgataacgcttgccttcattattattcccggccgacaattaaaatcagatgggtaaaaaggagccaacttcatcggcacatggagttaacttacttggtcatttaagttaacttacttggtcatcgaagttaacttacttttctgatacctttattttaatacaacccgaacctaagtgcgtttttatattcttctatttccacgatctcgttgagtttgccaatattgatacgatgagcgtcatctacaaaaaacaatatcctttcgcatggcaataaatatatccttcgtatatttgttggaaattaaaaataacgagcatggaagaaacaagtaaagttacaaaaagccgggtacaccacggattcaacatctctatagcacgaaatagaaaaggtttgaagcaagctgctttggctgatatgctcggtatatcccaacaaaggctgtcccaactagagaaccagcggggtagtcaaggacgagatactagagaaggtatccgaggcaaccggcgtttccgtagaagatttaaagacgattgaggaaccgatgagcgtttatattgaaaataataacacaatatccgattcatcaaacattggaagtgtcggtgatagtattggagaatacacacaaacatataacaccaatcccctcgacaagatcgtagagttatacgaacgtctcctaaaggaagagaaagaacgagtaaagacattagaaaagcgcatcaaagagctagaaggaaaagcgtagatcttttttgacaccgtccagcattttgtgtaaatagaaaactttaggattcaggtttcatacttgaatccagttttcaaatatagtaataaatcgatagtcccatcaaataacatcttatcaatagttgtttgtatcttcatcaaagaggaatggactaattctgtatcacatataaataccttctttttcaattcggtttctcaaaagtgaatccatgtgatcccgtaatcggacgatatcgacattacaaccaaacagagtttgcagatcttcctttatatgtaccaatgcgaacatattaggctttgaggtttccaaataaacatcaacgtcactatcttctgtttgctcccctctggcaacagagccgaatattcccatacggataatgctatatttagaagcattcttcgccatataatcacgcaagatattcatatattcagctgttgattccatatcctcttattcatttgatacaaatgatacgtgttcaattttaaacaaaccataaaaaaaggcaactatcttttagataactgccttttattgcgagccgaaagccggacttgaaccggcgacctacgcattacgaatgcgttgctctaccagctgagctatttcggcaacatttgtttctttatttcgggcgcaaagatacagggtttatttgacatctgcaagaagattcgctaaaaaatcatctaaatccgcatctaaatcttttaatagaggatcgtccagacgaagcatatcatcgtctatgaagagaagttcctctatcacaacaaaatcttcatcagtcaagctaacagaaagaggtttcatgaaccggggagcgtcaaaaatattcttggtggataagatcgtaaggaccgccttcaccgaagcggcaactcgcttattgaatgcgttctcctcctcgttcgagttcacccaatcgaagataacgatcttttcgatcaaatgctcctcatcatcataaatttgcagttccccgctttccgcatcggcctgcacatataagtcgcttataaaattaccggactcatccttggccagcttttcaatagccgacgtaaaagcattctcgatgagggattgaacctttgctatatttgcgttcatatattaattctcctttattcgaatatgcgtcaaaagtaataataattcaccgaataacgccgttaatcctcaccaaattgcacatttagtttcttatcggaacgaattcgttcggccaacgcctgcacatagagttccaataatttggtactcttatcattatcaccactattacgcttgaataaatcgtatgatttatgagcccactcataggcttcttttaaatctcctctcatctcatggcatagggccagattagaggccgccttcgcccggcttttccagttttccgtaccccggtaaagcccggaccaacgatcttccgccatatcccatttctcattagccgcataagcggaagcctctttccaacgtgaacccattccggtaaagtaccaacgagtctccttctcccaatgaggaacaaaattagcgtagaccttcgccccgaaatatttaccggccccacgcaaagcattctccggagagggcaataccttatccaagatcggcatataatccgcactttccgcccaataaatactatctttcatatgtaccgtcgccagtggagcctcacgatcgggaacgtaactgcgtatcacgccagccatctgcacgtcgatcattcccattacatacccttcgcccaaggtacctacgcttttcttcatatcgaacagcaagcggtcgatggagataaccgcatcggcaccggtctcatcgcatagcgacgctacttgcccttgggtaagtttcgtatccagaaacgcctgattatcttttcgaaccgcatcatggtaaagcaatacgtcgttaaaataagaagcctccacgatagcctcccctaaagtacggcaagcgtcaaacagcgcactatccgctttcgctttgcaagtatcttgcctctctccctgcaaggtgtattcgtaacccgcatcctccggttggggaacggcattgtttacgataagtaccttggcgacattctcaggaaacgtcacctccgcaggattatacgtctcgatacctacataattaatcgtgctacaagcggacaacaaacccgctatgcctataaaaagaatgcttctcatcttcatctatttaaaagggggcgatttacgcccccacattatgtcaaatcactcacagccttgaaatagccgatagactccgcgatccccaagaatgggtctttcatgtctttctcgtattccaagctacacattcccgtgtaattaacttcccgcatcatacggatcagcgctgggaagtcgatctttccacgaccgatctcgatcccgactcccgccttcgaagaatccgtcacgtccttgatatgcatatcaaacacccgggtatggtatttcttcaagtcggccacaggatcacagccgtttcgcaagtcatgtccgacatccagacacataccgatacgggggtctaaatccttcgtatgctcccaaacgtccgtagcatcgggatacgtcttaatatcaggaccgtgcaagtggatagcgtaatgaaaatcatactccttcacttttttatccacatagggtaaaagctcgtaattcgggacaccgacgattaacttcactcctacccgcttcgcataatcaaacgcacggtctatctcttcctcgctcttcatataaataggacctacggcatatcccgtcactttatgggcagcgcatttatcatgaaaagcccgaatctgctcatccgtactattcaacggcaaatggaaatccttgatgcaaagataatggatatctaatcgttccaacgtcttcaacgtcgtatctaaatcaaaattaacgaaagtatatcccgccattcccagatggaatggatttacggccttcggagcctttggttttacagggtccggcaaaccggccttagcgatagcggaagttcccaacaagagagccccggccaatccttgcttaaaaaataaacgtcttgagtgtttcatggtttatattatatataataatgtatactatcatcataaacagttttcaccccgcaagataataaaaagatctttacgagccagcattcggacgaatcagtggcaaagttacataaaagatcgagccttttcccagctcagaggtaacccatatctttcctcccatttgctctaccaatccccgacagatagccaatcccagtccaacgcctttgctccaactgtccaattggacaaaacggctgaatatggaatcgatcttatctctcggtattccctctccgctatcctccacgaaaaactcgacagaagccgccgttctcttatatccaaaacggatgaaccccttctcggtatgcttgatcgaattcgtgagcaaattcgtaaggatttgtgtcaagcggttcttatcagcctccatcaccaaggcctcgcagtcgttcagtcgcaactctatgcccgacggcatacgcaacaagatcatgctataaatctctttcatcagcaaacgaatatccagctccttataaatcagaggcatggaatttgactcgatcttggaaagatcgagcacatccccgatcaaccgctgcaacaactcattattactttggatgatatttgagaactcaagccttgtctcccggtcttcctcatccaccaatacttgcgagaaacctacgatagcgttcaaaggtgtccgtatctcatgattcatgttcgctaaaaacgcggacttcaggcgatcggcttcctccgccttttccttagccctctccagcctcaatccgtaccgatgccgggaatacgaaatatatcccaagaagcaacagatgatcatcaaaatcgcaagacctcctcccattgtcaataaattagcacgtagatggctcgcgtccagctccatcttcttatttgccaattccagtttatccacatcatgctggttcctcagcatagccaaatccgcataaaattcggcgctcataagcgagtctttcaaatgcgtatatatttgataggtcttagcggattttaccccttcccctttctgtaaaaggatatccgcctttttcgccagcatcaatagtatttgggtattcttcttttcagagctaacgatagagagtaacgtatcgacaaaggttaaagccctgtcatagtcttttataaatatagaatagtccagctccaagttcatgaccgtttgagtctctctaactaaattcgcctcttccacacaacgtttggtcaatattaaatgcgaatgggctaatttggcatcattcatctcgataccttgaaccgcatacgaacggtgatagagatatttaaggtaattcaccgacatctcttcattcaattccgtaatcccattcccgtcacaatagtcgatataggctttcaacttctccagatagcgtttccttgtctcgaccgtcctccctttgttcaatatctggcgaatgatataaatccgcttgggcaaaggggtgtcacgctcctccattccctgaagcacctcttcgtataaggcgataccttcactcatgaatcccgtctcgatataaaagtccgctaacgcttggttcgccatatcggcaccctccgggaaattcaattctttagaaagggccttcaacgcattcacctcccgcagaaccccatcatcctcccggcggctcgtcatggtatagatattccagccttttacccgaaacaggtcctcaatacgccctacctccaaaaacacaggctccgctttttgtatgaaatagcgcatactatccgtatttttcgaatagtaatagcgaattagcctatacaattcgtccgcctcctgccggcgcaagctatcactccccgccgccaatatacgaacggatgacagtaaaagcaggaataggaaaataatacgtagttgtctcataccgcaagattataataattatcactacgagcttatcctcggccgtatcaatggcaaagtcacatagaagacagagccttcacctaccctcgaagtaacccggatatttccacccatctgttcaaccaagccttggcaaatagcgagccccaagccaacccccttactccagttatccaattgcacgaaacggctgaatatcgtatcgatcttatcttccggtattccttctccactatcttgcacgaagaactccacggataaagccgatctcttatatccgaaacgaatagatccctcttgtgtatgcttgatcgcattcgtcaacagatttgtcaggatttgagtcaggcggttccggtcagtctccataaccagctcctcacaatcatataattcaagctccaccccctcatgcatacgcaataggatcatgctataaatctctttcatcaaggtagggatatcttggtccttataaatgagaggcatcgaatttgactcgatcttggataggtccaggacatccgcgattaaccgctgcaacagctcgttattattctggataatgtccgcgaactcttgtcttgtttcccgatcctcctcatcaaccaatacttgtgagaaaccgacaatggcatttaatggagtacgtatctcatgattcatattggcaaggaaagccgatttcagacgatcggcttcctccgccttatcttttgcctgtttcaattgcaatccatatttatgccgtgaataagaaatataccccaaagagcaacaaaccagcaacaatagaacaagccctccacccatcaccaataatttcgtacgtgaatgagccgcctccaattccatcttcttatttgccaattccaatttatccacgtcatgacgagctcgtaaattcgctaaatcattataaaatgcagcattagtcactgaatccttcaaactgatatactcgcgatacgcatccgcagcctccattccatggcctgaattatagcatattatggccttatccttcatcaatcccaatacggataccgccctcttacgttgtaagcaataatcaattaactcattagccaatgctttcccccgctcataatcgcccgatatccgataatagagtaaacggatattagaaatcgagagatattcattcctcatgttacagtctttaaccaacttctctgcacgaactagatggaaagatgtgagggcgacatctttcttatcaatacccagcaaggcgtaactacggtgatagaggtatttaacataatataaaggagtatcttcgtctaattcctctattcctttttcttcgcattccacgatatactctttcaatttctttaaataaaacagtctcttcgatgcttggatattttcattttgtaaatgccggataacggtaatccttttggccaatggggaatcccttttctccatatccaggaaaacctcctcatacaaggcgattccctccgcatcaaatcctgtactgaagtaaaaatccgccagggcttgattcgccatatcgataccatccggaaaatcaagttcgctggatagatctttcaatgcctgtacattctctagcaccctttccttctcgccattactcgataaagcgtaaatataccatcctttaatccggcaaagatcctcataacgtttttgggctaaataaataggctcggctttctttatgaaaaaatacatactgtctatattccgggaataataataccggatgatctggaacaaagcgttgcctttataagtatcatccttactcaactccgcctccttgagcaatctatccgcataatatttataatccagcccttgtcctttatcactagcaagttcatccaatttcacaagcctgtcacccgaaggcatttttgccagcacacattccatgctatcgatatcagtggccgcagtagctacaaatattggggtaagagataaatatattattaacagtatgtttcgcatttaaagtttacaaaatagacatcaattagttaacgtgtggcaagttagtaaaatttagacaacagcgtatcattatttacaagtttaatattataattttcaactcaatcaacaaaaaagcctatatcaatcaaagaaagattgatataggctcttatttcaaagaaacagctgttctctttattttgtcaaggcggcgatactttcctcgatagacttaatcttcaattcggcatcggcttgctttttcttctccatctcgattactttcgccggggctttgcttacgaaattctcattgcctaatttcttcatgacagaagtcaagaaacctttttggtatttcaattcttcttgaagcttagccaactcttcttccacattgatcagattgcctaaaggtacggcatattcagtcgtacgtaccaagaacgatacagcgccggccgctttctcctctaccttggagatggaagagaggttacacatcttagcgatcacagcgttgaatgcctcattgtgctcacccacgatctgcaattccagcgcatccttattcggtatattcttttgcaaacgaatggtacggacaccgccaacgatctctttcacgatctcgaaagcatccaaataagcgctatctataaccgctatttccggcatttgggcaaccatcaagctctcaccttccttgcgaggctcaagggcttgccataattcctcggtaataaacggcatgaaaggatgaagcaaacgaagcaaggcatcgaagaaacctaacgtagcctcataagtagccttgtcgatcggctgctgataccccggttttaccatctccagataccatgaggagaactcatcccagaacaatttatagacagccatcatcgcctcgctcagacgatatttactgaaagaatcgtctacctcggcgattgtcttatccagctgcatcttgaaccatttcacggcgatagcggaagcctccggctgggcgatcgtatcgtctaccgtccagcccttcaccaagcggaaagcgttccatatcttattattgaagttacgtccttgctcgcacaaagcatcatcgaaaggaatatcatttccggcaggagccgcgagcatcaagcccatacgtacgccgtccgcaccgtattgctcgatcaattgcaacggatcgggagagtttcctaaagatttggacatcttacgtcccagcttatcgcgaacgatacccgtaaagtaaacgctcttaaacggcattttccctctgtactcatagccggccataatcatacgggctacccagaagaaaataatatccggtccggttaccaaatcactggtcggatagtaataattgatttcctcattatccgggttattgataccgtcgaacagggagatcggccacagccaagaagagaaccaagtgtccaatacgtcctcgtcctgacgcaaatcagacagggtcagattcgggttaccgcatttctctttcgccagttccaaagctttctcttccgtctcggctaccacgtaaccgccttccggcaagaagtaagccgggatacggtgcccccaccaaagctgacggctgatacaccagtccttgatattctccatccaatggcgataggtattcttgaatttcggcggatagaacttgatatcgtcgttcatgaccggctccaaggcgatctgggctagatgttccatcttcaagaaccattgcatagacaatttcggttcgataggcacgttcgtacgctccgagaaacccaccttgttctcgtaagcctctaccttctccaaaaggtcagcgttacgcaagtcttcctcgatttgcttgcggacatcaaaacgatccatgcccacgtacaggccagcggcctcgctcagcgtaccgttatcgttgaatatatcgatagaaggcaaattatatttctcgcccaacatatagtcgtttacatcgtgtgccggggtcactttcaaacagcccgtaccgaactctatatctacgtaatcatcctcgatcaccggaatctcacggcctaccagcggaacgatcactttctttcctctcagatgttggttcttcgggtcgttcgggttgatacacatcgccgtatctcccataatcgtctccggacgggtagtggcgacaatggcgtatccctcctcgcctacgatcttatagcgaagatagtacaacttactatgctcttccttatagataacctcctcatcggacagggccgtcaacgccttcgggtcccaattcaccatacggacaccccggtagatcaaacctttcttatatagatcgacaaaaaccttgataacgctctccgaacgtttctcgtccatcgtgaacgccgtacgatcccaatcgcaggaagcacccaatttacgaagttgcttcaagataatgccgccatgctcttctttccattcccaagcatgccgcaaaaactcgtcgcgagtcagatcggtcttcttgattccttgcccggccaaacgattcaccactttcgcctccgtagcgatcgaagcatggtccgtacccggtacccaacaagcgttcttacccatcatacgggcacggcgaaccaagatatcttggatcgtattgttaagcatatgtcccatgtgcaatacgccggtgacgttagggggcgggattacaatcgtatacggctcacggccgtctggctttgacttaaagaagccgttatccaaccaatactgataccacttcccctctacttcagcgggattgtacttactagcgatttccatatttttataactaattagtctttacacatttctcgatccgcgaaagtacaaaaaatatagacaaaaaacgctgagcatcgggaaatatagtcggccgagacaataggcattccctgtcggacacgccactattctacaaaccacgacgtggtttatacagaccaagccgtggattgtacagatcacgacgtgatttataaggaccacgccgctattttgaaaatagagtgaatggcaattacttttacatccggggatttgaaggtttattcctataacaagcaaactatttataacggtttttctattccgcgctattgcagtttcgcgtaaatgcctgtatcttcgcgtactataaaaaatagatatgagaaagcgatctgagtataaaggaggggataatcgacataaaccctctaaagaacgacgggtaacggtgggtgaaagtaacactttgctacctttcctgttcgagttattaaaagaacaaagccgttcatccgtgaaaggattattgagcaggggacagatctcggtaaacgggaaagtcacccggcagttcgatgccccgctgaaccctaacgatacggtcggaatcaactatggaagagggaaggtggaattcaacaatccgttacttagaattgtttgggaagatgatgacctcatcgtgatcaacaagagggaaggcttgctatccgtatctaccgatcgtgttaaagagcgtacggcatatcgcttattaagcgattatgtgaaacaatccgatcctcgtaataagatattcgttttgcaccgtctggatcgggatacgtctggtatcatgatgttcgctaaaaatcaaggcgtaaaggaacaacttcaatccaactggagcgaaatgattacccaacgtacctatgtagcggtaatagaaggcaggccggagaaagatacggatttgatcgtttccaatcttgttgagaataagaatatgcaagtgtatgtgacgttggagggagacggaaaagaagcgatcactcgctaccgcctgttacaaacgaacaatagctattcgcttctggaactggaactggaaacgggacgtaagaaccaaatccgcgcccagatgcaatctatcggtcacccggtagccggcgacaccaaatatggagcggagacgaatcctgcgggacgtttgatgcttcatgcccgtaaactctgttttatccacccggtaacgggagaggaaatgcgttttgagacccggattccggagatcttttcatcaacagcaaagtaactttagcaataaataataaaaatgaagaaactcatcagttcgatcatgctggcgctattagcgctggtagcgcaggcacaaatacttacgcctgtcaaatggaaaattaaactagacgacaagggcggcgcacccgagaaagagatcgtctttaccgccacggcggacaaaggttggcacctgtatgacatgaacctgccggaaggaggtcctgtatctacatctttcacattcgagacattgaatggagctgaactgattggtcaaccggttccttctgtaaagccgaccacggtttacgacgagcaattcgccatgaaccttcgttggtatccgggtacggtatcgttcatccaaaaactaaaaattaccgatcccgctaaattcaaggtagagggcgaggtggaatttatggcttgtaatgacgagacttgccttcccccagatcaaatacctttctctttcgataagaaaagtatccatctagatccagctctggcagctaacagctcgactacagaggtggataaagaggacgccacggccatacagccggatacgcaagtcgtagcggaagatgctagcgagttgaacactccggaccctgccgctaaagagacaccggctatgacatctcccaaagcgtccgacagcttaaccgatagcccgaatctttggtctccggtgatcgaccaattgaaagcgttcggtgattctacagtatcggcggcagatacctcttggttattcatcttcttcgcaggtttcttaggtggtttgatcgccttattgactccttgcgtttggccgatgatccctatgacggttagcttcttcctgaaacgtacgaaagatcgtaagaaagcgattcgcgacgctatcacctatggattatctattatcgtaatctatttggttatgggcttgttgattaccggcatcttcggagcgagcgcattgaatgatttatcaacgaacgcgatctttaatatcctgttcttcttactgttggtagtattcgcagtctccttcttcggagccttcgagctggtattacctgcgtcatggaccagtaaattggatagcaaggccgattcaacgaccggtatattgagtattttctttatgtcgtttacgttggtattggtatctttctcttgtacgggtccgattatcgggaccttgttggtacaggcagcttctatgggtacggcggtaggaccggctatcggtatgtttggtttcgccttggcgttatccatcccgttcagtgtcttcgccatcttcccgaatatgctgcaaagtatgccgaaatccggcggatggttgaattcagtgaaggtcgtattgggcttcttggagttggcattggctttgaagttcctttccgtagcggacttagcgtatggttggcgtttactagaccgtgaggcttttatcgtgctttggatcgtgatcttcagcttattgggtgtttatttattaggaaagatcaagtttagccatgatagcgaagtaaaatatgtatctgttcctcgtctgtttatggcgattatctctttcgctttcgccatttacatggttccgggactttggggcgctccgttaaaggcgatcagcgcattcgctcctccgttgtatacacaagatttcaatctatacaaaaacgaggtacacgccgcattcgacgattatgaatccggtatggcttatgccaagaaggtaaataaacccgtcatgatcgacttctccggtttcggttgcgtaaactgccgtaagatggaggcttccgtttggacagaccctaaggtgaagcaaatgctagaaaatgattacgtgctaatcactctcatggtagacgataagaccaagctcccgcaacccatcgagatccaagagaacggaaagactcgtaagttgaagacgatcggtgataaatggagttatttgcaacgaagcaagttcggttctaatgcccagccattctacatcttattgaatgacgagggacagccgctcggaccttcatacgcattcaatgaggatgtttccaaatacatccagttccttcaaaacggattgaaagaattcaagaaagaacaacaataaaacacatacagagggccgggttctaccctgccctctttcttttacaatcattatagaataagtaataatatggcaactagagaagagaagatggaagccttcgggcaattactcgacattctggatgaattacgggtaaaatgcccatgggatcgtaaacagacaaacgagagcctccgcacgaatacaatcgaggaaacctatgaattatgcgaggccctgatgcgtgaggataacacaaacataaaaaaggaattaggagacctgttattgcacatcgtcttttactccaagatcggcgaggaaaaagaagctttcgatatcaaggatgtctgcgacagcctttgccagaaactgatttaccgccatccacacgtattcggagatacctccgccgataccgcccaaaaggtagagcaaagctgggagcagcttaaattgaaagaaaaggggggtaacaaaaccgtgctggaaggtgttcccgcttccctcccatccgtagtaaaagcgcatcgtatccaagataaggcccgtaacgtaggtttcgactgggaacaacgggatcaagtatgggataaggtacaggaggaatttaatgagttgaaaaccgagatagacaggatggacgcagataagatggaagctgagttcggagatctcttctttagcttgatcaacgctgcccgcctatacaaaataaacccggacaacgcattggaacgcacgaaccagaagtttatccgccgttttaattatctggaggaacatacgatccaagaaggtcgttccttgaaagaaatgacattggaggaaatggaccaactatggaatgaggccaaggccaaaggcttataaagctaggataagggcaaaacaaaaggggaaccgacatcacgtcgccacccctcccttaacttaaacgccaaaactaaatctaaacaaaaaacacaaataatgataatattttactttttctgtttctcttccttcttgttgtcccgaccactcttcataaaattccggacaaacttatattccgcatttcggtatttatagaccttttcgggagaaagtatcttcttgaatctctcaaaatactctttttccaactgtgcctcttttatctcaacatccagacattcgtctatcactttgttataatcagcatctgtcggattctccttatgtcgaatttcttttgataacttacgacattcacgacctacctcaaattttttctgtcgcaactcattgcataaaggaataaattgtgcagcttcctcaggtgtaaggccaacttcagccgtaataaaagcattccgccttgcttcgaatgcttctctatcaaaatgtctttgctctttcttctcttgtgccgtagcattgaaagagagtagaaccgaaatcgctacaaatgtaatgaaaaatattttattcatacaagtattattacaaaaatcttcgataaaattactattttaaactttattcagaataggaaagttcctcatctaagagataattggcgtactgagcttccaaatactccaaatactcctcatcttcttccgcttcaatagcgtctaaagccgttgtcgggacttccgtccggaccagtaaagaatcagacgcagtactaccatcggaaccgtttattcccacgatagccttgaaaaacaaaccaagaccagcgaataccgcagccatgtacaaccacggacgaacacgatccatcaaggaaatccgtttcgccctctcctccggcttctcggggagctgactcatgatccgctccgtaagcccttccatatacccttccggtacagtgaaaggattagttcctttcaagcgatctaggttgttttcttcttttttcatactttttctctttttatattgctttgacagcgattcgggcaaaaggtttaaacctcttttgttaaaaactcctcgatttttttcaccgcatgatgatacgaggccttcaaagccccgacagaggtacctagtatctcggacatctcctcgtacttcatctcctcgttatacttcatattgaaaaccaagcgttgtttctccggcaaggtaagaatagcgttttgcaatcttacctgtatctcgtcaccatcgaagtattcatcacctttcaaacgatccagcaaaaaggtatccgcatcgtcgatagatacgttattcatatttcgctgtttattcaggaaagtaatgcactcgttgatcgcgatcttataaagccatgtagataatttggcctcactacgaaaaagctcgatgttcgtccaagctttcaaaaatgtattttggagtaagtcgttcgcatcctcatgatccagtaccatctttcgtatatgccaatacaacttctcgccatacaagcttacgaccttggcgaaggcctcacgttgtcgggccgggtcccggagctgtactacaatttcgtcttctgtataggattgcattttttctattttgggaagtgcccagaacaggactcgaacctgcacgatcgcaaaaccactcgcacctgaaacattacgatatcccttccggctttcagcgttccttcgtggaaaggataattatgggcatacaatctgatatctttggtaaaagtggcatttaatgtttgataataagtcagcacatccccatctatgctataggctgcccctaaattgccccaatgacttacattgaaaggaatgccgtcaattgtgccatacgatggctgagtaactccggaattcgacataaaagggagccttcttttactactggaaatttcatagctatccctaaccttcgtatagactttgtaggtggttccattaaaattacaatcgacaaagtccttgttctcaatttcatatccttgtacattttcgatatttagggagaaataatttttgttgtagattaagtctgtagggtctagtacgacgagagcgaagtccggtatatcgatgcgggatgggccgtagtctccacttaatgttctgtatttaagataaagactggctccatcctttagcgtaagaacattctttttactatattgaggctgtccgactcctatgccagatgtatatttattaccattggcctctacatataccgcccccgatattgttatcttacccatattctcttgcatagaatatactccaattgcgggagaatcagagcgtaggatgttacccgactctacatttgctattaaaatacccgtttcacctggataatttgttatgattacttcatatgggtctgctacattgattgctggtcgggaactcgaagcttttaggctgttttttcctcttagttgtaaggtcaccgtaccttctatctgtaggtataagccacttgccgttacattatcaagcgtataagtgccggttttcaatatttttgttccataactaccattcgatatcgtcgcccccggcgttaatgtctcattttgcccccacgcctccgggcatccaattcccagaaacaaaaaaagcaaccagatcgttagttgctttacgtggttcccatgtctaatttttctcatattcttatctccattttaaattgccattattgattgaatttctccgcgttgggtgcaacggtgtctccgtgccgggtgcagaggtgtctccggtgtggagacagggttgtctccgaggtgtcgataggcttatcgacaccccggagaatgtatcagatctcgtcgggactctcgctgtcgcctccgccgccggcctcacctacgtgtacggatatggtgatagaccggggagttttcagcaaggatttgcctttcatatattgcgtgcagatcgtcagatcgtagttgccgtccggcaggccggtgggcacgaggaagatcaactcggaaggattgttcacggcgaacatgtcggaggttagcttcacctgcgctttggtctctacgtttacgaaagtaatgccaacggctggatcatcgccctctaccttgaggtaagcgccacggatagcgaagttgcggcccggtgtcatgctgccgtcggtaagtccattgctgcgatcctcggtatcgatcacgtacataaggtccgctttctcgccctgtatgtcgatctccgtcttctggatttcctcccgcaataccttgtcttgggtaaaggatacgtaaatgttgtttttctcagggttccagcgccctttctcgatcaagcccgtgaagcggggtacggcgtagaataagccggtgttcacgtggtatccgttcatcaataggcgggcgatgacccgctcgtaaagggtaactacatgtaccaaggtctcttggcgcaagccggtgtcttcggccctcatctcctcgtacaccttgtcgagcccgatctttccggcgggatccaagatgaggatcttgtcgttcgggtctttcgtcacggtgttcggggcgatccatccttttagtttattcagcatataacgttgttttattggagattagatacctccgtggtttattgatttacaattcactccctatgaaaacgactaatgaaaaccttcgtttacgttagtcgttttcatagggagttcagaggaagaggatggttttagataaattgatgaaaatcaacaattattcggcaaaaagggttgctttttggattataatatttaactttgcaaacgaatgaaaaaaacgaacgtttatgctagtcatttctatcgtttgttcaatttctagtatgaataatcttacatgtaagcctagaatcatagaggtataaaaagcaaagatagtccgtaacttcctagggtttccaatcaagtgccatgtaatgggctaatgctccgtctgacgcgaatatacttttatccgcgttgagcaatttataataaatagcggtcaatttatcgtaatacccatccgtttttggatcttgcggataatcaagatcacaatttaaaagccattcttgaattaaggatttagccttatactttcctatatcctcactggacatcgcaaattgtataatccatttcctatatatggggaaatactctttgccatacatgaaactgcggctaggtagcttgtctagttccgctaaaacagaattcattgatatgtatcccgaactgggcattaacttatccaaagccgtatatactcgaaaaggttggtcgttatagccatcgccttcgatacccttaatttcctcggaccaattgataaatgcccccgctaaagaaagaaacgataataccggatcagacatccttatagcctctaccaaagtctggataatctcattccatgattgtgctagcgctggcataggtggttttatcttcaagatctcattgactagatccttgacgggaacggttccgaatccttgcagagcggggtccgatagtaattgctgaaaagatccccggataaatccgattgaactattccatgcgccatcgcctacccaaagattacccaggttattatgcgtgattgtccatattgtccgtagggcggcatactcggtggtttgtgccgtatgcccttgggtagtaatccaggtgtttaatgctcctaatgtatcaccacccactgccttgagatcctcgtatccctcttcgatcgctttccctaaagtgctggatgagatgatatgccgcctatgttctcccaatcctacaggtagatcgctttgtacggacgtggtgaaagcagggcgggcacccatgttcttgggtcccattattgaacctctgatcgtacgcgtcagtacgcctttatcccatagcgcgcttgtgaacgcttcccaatcgtcatattcaattacttcattcttacccaagtcctcgttaaccaattcccacatggctttggtacccgtgtctttatacttgaatttttgaagggcgagcatcaagttcctcctgaactcccggccggaatacctctcgattgaataggtcgtgccctctactttgatttgcctctgtatcacgtcgcttagatgggcttgcgccaaggtctgtggcctgttatcaatccagtttatgccggctgtcctctgtacggatggaaagttattcgtacgggatatccttttgtggggcttgtagtctcgcataagaggtgttttagatgtaggttgataaatgatggcaatttatggaaatattttggataatagccgtaaatatcccgtatgtttgcgagtgaacatataaaaaaattaacgatgaagtatttagatccaaaggccgaccttatcttaaagcgtagattcgctgtaaagtctattattttccttacgtttgtgatatcacattttcgattgttgcgccaaaaggcgaatttcgtggttttctatcataaaaaagccgataactttcatgaatatcggctttttgtatcgtatttatctgaattgttaaaacctccagccaatattcgcttggaacacgccgttgcggacggtagactcgtccgccataagggggaagtagttggtttcgccctcgatttggatgtctttgtattttaatacatcggttaagccgaagttgtaattcaaggtgaaaaagagaccgttctcgaattgatagccaccacctacgcataaagagaagtcgaaggggtagaatagcttatctacgttgacggcgacatactctttcttgtgtccgtctagcttgaatttgttatgtacgttgaagcctaactgagggccggcaaatatgttcaaacctttatagacgtatgctttcgcatagatcgggatgttaatgtaatcgttgttgagattagcggagatgtattcccctccataattatgttttttcgtggcaccttgcatggagtagtaaacaccggcttccaccgcgaacatatcgtctggaaaaatatactcaccgctaacgccaacgttagcgccggagcgggcactgccatctagccccataagtgtggctagactgaaacctaccttaggcatgaaatgaaactcctgcgcttggattctcgtggtggagaaaagggctatggtcgccagtaggagcgtatagatgtagttcttcttcataagtcgatatatatatataatataatgtataggaaaaaggggttgtttataaggttcaaggaactttacaaacaacccctgttattttacttattattctcgatccatttgcgagcgttcacgaacgcctcgatccatggagtgacctcgtcgttctccttacggtcggcggggtaataaccgcactgccaagggaagatcgcacgttcggggtgaggcatcatagctaaatggcggccgtcctttgagcaaacaccggcaacggaccaaggagaaccgttcgggttggcgggatagccatcgtagttgtatttagcgatgatgttgtactccttctcctcgtaggggaactcgaacttaccttcaccatgagctacccatacacccaacttcgtgccgctcaaggagccgaacattacggagttgtttttcgggatctccaagctaacgaagttagactcgaacttatgggaatcattgtgaaccatcttatgctttttctcgtgctccggataaaccaagcctaactcggccatcaactggcaaccgttacagatacccatgctcaacgtatccttacgtgcgtaatagttgtcgatcgctttcttggctttctcgttatacaagaaaccgccggcccagcccttggcggaacctaatacgtcggagttggagaaaccaccgcagaatacgatgaagtttacatcctccaaagtctcacgtccgctagccaagtccgtcatatggacatccttcacgtcgaaaccagccagatacaaggcgtaagctgtctcacgctcgcattgcgtacccttctcacggattaccgcagccttgatgccgttcggagcgcggcgttcggctgagagtccgtaagaagaaagctttccggtaaagtccttgtggaacttgtactgtacgggctgcatcttatagttctcgaaacggtttccggcacaaacgcttccgctctgctttacatccagtttataagaagattcgtaccatacgtcacgcatatagtcgatgccgaagtgatattggatgccgtctttcgataccaatacatggcgctcgtcggtcggtttggcgatgatggcgaaacctacgccagcttcttccatcaacttttcgaatgccttcttgtcctttacctgaaccaagatacccggattctcggcaaacaggatcttcacgatatcgctctcggagatcttatccaagttgacatccaaaccaccctctacgttggcgaagcacatctctaacaaggcggtgatcatacctcccgctgagatatcgtgtccggcaaggatgagtctcttctcgatcgcgtcttgtacggcgttgaaagcgtcacggaagtattccggatctttcacggtaggaacctcgttacccagcttgttcaaggcttgggcgaaggcggaaccacccaacttcaaggtatcgaaagagaagtctatataataaatgtatgtattcttgtcttgagctactaccggagagacgattttcttgatatcgctaacctcggcgccagcggagataatcaccgtacccggggcgatcaccttatcgtcgccatatttctgcgtcatggataaggagtccttaccggtcgggatattaatacctaagctgcaagcgaagtcggaagcggcttgtacggccgtgtacagacgggcgtcctcaccttcgttgcgacacggccacatccagttggcacttaaggacacgctctccaacttatctgtcagcggagcgaatacgatattggtcaatgactcggcgattgccataacggaaccggcggccggatcaaccatggctacctggggagcgtgaccgatagaagttgcgataccagctttcccgcggtaatccaacgctacggcacctaagtcgctcaacggcaattgtaattcaccttgacattgctggcgggcaatcttaccggttacggaacggtctactttgtttgttaaccaatccttgcaggctacggcctccaattgaagtacgttctccaaataatggtgaagttcggattctttgtaaacaaccggttgataagattcagtgaccgtatggtctgtcataaccgttctaggcggtttaccgaacatatattccagcttgatatcgataggttttacgccgtccgcttgttcgaagacaaacttcatgtcgttagtagtctcgcctaccacatacatcggggcacgttcacgatccgcgatacgttttacacgggctacatcttcttctttcatcaataagcccatgcgctcttggctctcgtttcctacgatctccttcgctgagagagtcgggtcaccaatcggcaatttgctcatatcgatgtgtccgccggtagcctccaccaactcagacaagcagttgaggtgtccacccgcaccatggtcatggatagagacgatcgggttctcgtcagactcggcgatcgcacggatcacgttagccgcacgtttctgcatttccgggttggcacgctgtacggcgttcaactcgataccgcttgtatattgtcccgtgtttacggaagatacggctccaccacccataccgatacggtagttatcgccaccgatcacaaccactttttcgcccggttccggatcgcccttcaaggcatcacgcatattcgcgaaacctacaccgccggcaagcatgattactttgtcgtaagcgtatttcttatcgttctccgtgtgctcgaaagtcaataaagaaccacagataagcggctggccgaaatggttaccgaatgtagaggcaccattggaagccttgatcaagatctgctccggagtctggtataaccaagggcgggggtctaggatcttctcccattcgcgagcgccttctgtacgcgggtaagaagtcatgtagacagctgttcccgctatcggcaaggatgccttaccaccgcccagacggtcacggatctcaccacctgttccggtagcggcaccgttgaacggttcaacggttgtcgggaagttatgcgtctcggctttcaaggagataaccgtcttgatatcttttacggcgaagaaatcaggtttgtcaccggataggggagcgaattgctctaccgtcgggccttcattgaacgctacgttatctttataagcggaaaccaatttattagggttctcggcggaagtcttcttgatcaagttgaacaaggaactttctttttcctcgccgtcgatgatgaatacacctccgaatattttatggcggcagtgttccgagtttacttgagagaaaccgaacacctcgctatcggtcaacttacgtcccaacttctggcttacctcgttcaagtaagcgatctcctcttggcttagtgccaagccctcttgttggttgtacacttccaaatcctcaatatagacaataggatctggttttttactgatcgtgaagatctcctgattcaagccattgtagatacgttgcaacatcggatcgtgatccgcgtcgccagaagaaacaggaaaatattcctcaatacgggaaataccggtcaggcccatgttctgggtaatttcaacggcgttcgtactccacggggtaatcatttcccggcgtggccctacgtaccagccttccaatgtttctgattgaacaggagttgcctcgctaaacaaccaaaccagtttttgagtgtcttcaggagagaaagcgtgcgcggcctctacagccagcaccgtctttgttgaagattgaaagaatagaatcatatcgttgatttattagtatttatcacgaaataacgaataagcctcttttagagagtgcaaagataatgatttcccgtgaattattatgtcaatacgttttaaaagaaaagagggcggaacctcccggcctcgccctctcatgtcccctgcatagtaaaaaataagagtgtgtctatattctaccagcctgcgttctgttgtgcggctagcgtggggtttcttaatatatcattcaatgggatcggccaaataaagcgtttatctgtgtacgggatgaactgtttgctgttgccgaaccattctgctttcacttctccaccaacaacgaatgcgccttggttcttcacattgttgtattcgatctttgcgggaataccaccggacggcagcaagtcgtcagccgctaaacgatgaatgtcttcccaacggcgaccttcaccttggaactcaatgcgacgttcccaaaggatagcttctaccagcgctttcgtgttggcgaaatcgccagccttatacgtttgtgtagcggggtcggccaaagaacggtctcttacttgattcaatttctccaatgcgagagtcttgtctcccgcacgtgcggcagcctcggcctcgtttagcaatacctcggcatagcgcaggatcggggcatactcttcacgtgtttggggattctggtatttatcacagaagtaataatcgtcagacgcacgataaaggacgaggttacgacgcttgtcatcccctttccagaatttggagttgtaaagggtaggggatgtcgggcacatcgcacggccaccttcacgggcagacatcatagcggacatagctccatttacagatgcgttatcttgagagtcattcggaatggagaatatagattcctgattgtctttgtaagaaacgaaaggagtggcaggattggtttccagaatgaaacgtccgccttccagtttcttagcttcagtaactacattgttccaatcacgcatatgcaaatatacgcgcgttttcaatgctatggcggcacctttgcttgcacgtccgatcttatcggcatcgataatgtctggaagcatgctttccgcattattcaagtcgcttaatatctgatcgtaagtatccttaacggtagaacggcctatgctttgttgctcagcgagttggctgggatcatttacggctttcgtataaataggcataccgtagttattgttaccttctacgttatagggcagggcataatggatcatcaagttgtgataggttaacgcacgtaagaacaggcattctcctttgtactgattccctttctcttcggttatgacacccgccgctaccgcgccttctatacctgcgtataccgtattatagcggttaatagcctcgaaagaggtttcccacatcgccacgttattagcggtagtcaagttataggttgcggaataggtataatcatagaattgggcggttaggttcatatcttcaccgcgcatttcgccttgcaatatactggccgctccaaaaggataaccgcgtgcccacccaaagtcattcggatctacgtacataccacattgtgcggcatcgtaagctccgactacggctaactcgcaacgttcttctgtcccgtatgccgtaagctcggagaatttgtcaacaggttcaaggtctacgacgtcgctttcgcaggcggtgaacacgggcagcgagaatagggctgtccctagcgctactactgaaatgtttttatataatttcttgtataacataattgtaacttttcttagtttgtgaaattagaatgtaatgttcgctccaaaagtgaatgaacgttgctgtggcataccgttccaatctacacctaaacgagagtttgtctcaggatccaatccggaataacctgtgatagtgagtaagttctgtccttgaacatagaaacgaatctttgtcatgttcagtttggatacgaccgccttcggtagtgtatagcctaaagctaacgtagatagttttaggtaattgccgctctcaacgaagtgtgaatccgtatatccatcattgaataaggaagaggcgtctccataaccgatttttggagtcatgccgtcacccggttgctctggagaaacccagcggcctaagatttctgttccgttgttggagaaatccatattgaacaatgcgctttgacgagaagcgttcatgatcttattacctccggagaagcggaagaatacatttaaatcgaaattcttgtaagaaacggtgttattccaacctccgtaccaagtaggcatagatgaacctaataccttacggtcgctagcgtccaaggaagaagccttggagacatccgaaggattggaaggatcatattccgcatagtcgtaagagccgaatgtgtcgaattgcactaatgaaccgtccgccttactccagatcggattaccgtttgcggcgtttacgccgtaataatcatatccatataaagatctatatgattctccttcacgaataattgtgtaattgtctacgatgtctgttccgccatataagctcttcaccgtgttcttagccgtggagaagttgaaattagtttgccagttccaatctttggtagcgatgattgtagcgttaaccgtcaactccataccggagttcttgatcttaccgatattatcaaaatatgagttgtaaggaataccggcggtaggtgctgtaggaacttccaacaccaagtctttggagttcttttgccaataagctagctcgaatgtcaggcggttattaaagaaagagccatccaatccgatatcgaaagtctcggttgtttcccatttgagctggctgttacccatacggttccaagcgatagctgtattcgatcctgctttcttcgccccgtaagttcccagataagggaaataattccctaggtcagagtttccgattgtagcgtagctggcacggacacgtaagtcgttaaaccaatcattaatagttgattcgctccagaatttttcgcgagagatacgccaagcggctgatcctccccagaatgtaccccagcgagtgtctgtcggaaggctggataagccgtccgtgcggacagaggctccgatataatatttactatcatagttgtaattcgcacggaacatataggaggctaatcccataaacgttttacctccagatacgaatctctcaccaaatgtgttggaaatgatatggtcggtgaagaaagcatcggatatttgttgcacggttgcgtccgtatattcatattcttgatgggtgtactcttgtaccgctgtcgccgtcaaattatgtacatcattgaatgtacggttaaagttgattacgttttgccagttccagttcgtgtatgtggtattgatttcttccaataagccgccatagccgtatccgtctcctgattccgggttccataccatgaaatctttaacattcgagatgtctaagcctgcttgtgtctttaaagtcaatccgtccatgaatgtgatttcagcccatccaccacctaatacacgggtattggtcgtacggtttacgttattgtctaatgcccagacgatattctggataccattatcaatataggaaaggttgcttccgcgacctaatgtcttacggttttcagcgtcgatattgtaaccagtaggatcatccggattgaatacagatacgtttggaagcatacgagtgccggcgaaacctacgccacccaatgaattctcgtcattcatgacaccattaacccgggtacgggtcatctggccatttaatccgatgcgtaaccattttgtcgcttgttgtgtcaaatctgcctttaagctcaaacggtttaagtcattggcgcgaatgataccttcttgttccgtgaaacctaatgatacataatattggcttttatccgtaccaccactggcggataagctatgattgtgctggaaacctgtacggaaaatataatcattccagtttgtgtccggtccgttcggatcgtaaacagcctgtcctttcattccccagttctcgtatttctcgttagcgatagtcacgaaatctttcgctcccagaagatcatgcaatttagctgcgctggctgcgcttacatagccatcgtaagttacttgagtacgtcccttggagccttttttagttgtgatcaatacaactccatttgccgcacgggagccatagatagctgtagccgcaccgtctttcaatatttcaatggattcgatgtcattcgggttaatatcagacatcgcgttgtaagaagcgtaagccattcctaagccggtttttccatcggcgttatcaccggtggcgatcggcatgccatctacgatgaataacggctgagagttagaactgatcgtactcataccacggatcttgaattgaggaccgcttcccaatacgccactaggagtcgtaacctgtacaccagcggcacgtccagctaattgagagtcgaaagacgctgttgccaagttgcttaagtcttcacctcctactttagatatggcactcgtcacatccttttttctttgagttccgtaaccgacaaccacgacttcatccaagttctgagagtcggactccatcgtgactttaatgattggttttactgccacttccacagatttcataccgatgtaggaaacgattagctttttcgcgttagaaggaacatccaaggtgaacgctccgttgtaatccgttacagtaccggtagtagtaccagctactacgatagaggctccaatgataggtccatcgtcttccgccgagataaccgtaccggtcaccttcgtggtctgagccgttgcgaacgctatacttgcaaacaagcatagtaatagataagtcaaccttttcatagacacatactttttgtttaatttgttaataaatagatcgttgtaatcaattgttgccacttggtcgattgacttagtttccgaagaacttcatgagagtaaggtactttggtgttacttcctagcattgatgccccataattatcctttccacgaaggaacgctgaaagccggaagggatatcgtaatttcagatagtaatcctattagccaagtttttaagacctcctcaaagggtctaacacttgatgcttccacatattccataaaactcagaataggtacaccaaataccgcaaatatcaaggtaaaaggcaaggtatggctggataattatattgagctacccgctggagtcatgaaagacgagaaaaacacacccgtatattattgtacaacaaccattcctgtcggaactgttaaaaaaataacctacaacgggatagaaaccggcaacttccgccaaagtgggactgatctatccctgtggcttcctgcaggagaacaggccgtaaagatcaccgacacgaacaatgccgtatacaccgcgactgtaaacgtaaaagaggaacatcaccaatcgtttaccgtataccctacagaattcaacatagctagttattcggtaacgatcagtacgagtactggaggttcgcaaaacgtaacctacaactcaaacacgtatgccagcccattcggtacgccaatcaccatcacgggtacctccacgagcggaaacaacgtgaccgtcaataacggcgctaccggaaatgtcatcttgaaggatctcaacatcagcggcaataccctgcccttgaacgtaaccgggaatacgacggcgaatatcacggtagccggtacgaacaatctgacatcgaccggcaaccacgccttgcaaattgagtccgggagtaccataagccttacgggaaccgtcgggaatacccttaccctaagcgccaccaacacgaccacctataaggacgtgaagacctcgggtacccttaacctcagcggcgctttcaccctcgtggccaagaacgggacctttccgcccacggcgaatatcacctccggcacgcccgtcgtgaaattggcggatacccagtatttccgggcgatcctgccgaacgctaccataggcacgctatcggatatggaatacgccggcggtacgcaggtaaacgaacacctgtttaccaccacgaccatcagcaacaattaccacctatggatgcccgccacgagcaaggatatcgtattcaagggtagcaaaccgacagccgccaccctctatacgattcccgccgccacattcacggcgcataacgtaacgctgaccgcccttccggtagtggccagcatcggctccgccatctacggtagcttggccgacgcgttcgccgacgccaccaacgggcagaccgtcaagatggagaccgcccatacgttgccggcgaacaccaccgccacccccaccacgataacctcaaaatggacataggtttgcttgcaaaggcttgataacagatcatcaagctcatccggcctgttataaacaggaataataatggagtataaacgcatatcttttgtataaaagtctagcacaaatgtagactcattttcatacatagtcaaggaacacacatggacaaatcaagaccagataacactgataatcaataaattaaaaacacgcatatggacatcccctgtttttagtactctttgagatattgatctagtaagaaacttacgtcggaaggtatttgtttgctttttttgatacgctgtttgatacgctgtttctgtttggatacagactcggggagagagttcgcaaaaacagctatttgggaagaactgaaccccatcttgattaaacagcaatatcgcttatctaattctgagaaatcagggaaatctttctctaaccgtgtatagaactgatggtattgcaagtttgtccagtttatgattaatgaccaatctgcatccttcagatatctaggatgctcttttaggtctttcaatttatcgaaataaggcaattgctcatctagtttcttatatgaggatttcagtagctcttcatatttctctatctctttatgggactccgcattttgatccaataaacttttattctctgaaacaatctcatcgatttcctgctgtttattatttaacgtggcgatcaattgctcattttcctttatacgattctcattctctcttatcgattccttgtaaattcgtatttgctctctagcatgcgctaaagatttttccttccgcaatacacgatattgatagacgattataagaatcaacagaaccgcagtgacaaacaagccgattatctcttgattcgttttttctagttttagctggttatttatgttcaacaatctctcatgatcataccgagcctgaatttcagccaattctccagcatgatttattacctgtagcgaatctgagtaaataagatattggttattatattctatggcctccttgtaaagtttttgttctacacatatataatataacacctcataggcttcatttagcgtatataaattgtctgtttctaacgatttctgaaagtaaacctttgcagagtctagttgccccaaactccaaaaagcactacctatcttgtaatatacttgaggaagcttatgtaaggaagatatttgtaaacataagtcaagctcttttctagtgtaatgtaaagctttttctccttgacttaatttattataaacaacgcctagctctcccatagccatagcttcgagctctatattacctaacctttgagcattatctaatgatttaccaaaatagaacaaggcactatccatttcatttttatgcacataagttcttcctagttctgatagagcataagatatccgttctccatttcctgatcgtaatgcgtattgataggcatctttcaattgtaccaacgattcttcataaagatcttgataacgatacgtatttcctaatgattggcagatcagataagtaaaaagcggctcatccaaccttgtcattatatctttagactttaaaaagagaggtatcgcttccgttaactttttctgatcctccaataattgtcccttataataatacgcttgcgccatccttttcaagtcatcctctttctcgaaataatccatcgcatcttgaaccaactcatccgaggaagggatattcaacgaatccggaaggcgtttaccatataccttatcccgggcttgtgccaacaatagcgcccaagtagcatagttctttccgcttgaaagtgatgattgaggcatagaacgtaatatagatagagcgctatccggatgctcccacataacagattccgcacgagataattccgctggtaatggtttttcttggcgcatacaagaaaaaagggtagcgaaaagtagcaaagccaccacgataacctcaaaatggacataggtttgcttgcaaaggcttgataacaggtcatcaagctcatccggcctgttataaacaggaattataatggagtataatcgcatatcttttgtataaaaaagattgaggataccctcaacagacagtatcactcaatcttatcaaaaaaactatagcttcaatagaaataaatattattgtaccaatagcatacgtttcgttgagatcaactgtccgtctactaccaaagaatacatatacatacctgcgacacctagatcagaaaagcttaccattatactaccttctccccgggtagcgatatcgaatttcttaacttgagttccttgcaaattgcaaatagagataaaagcggaacgtgcggatgtagggatcgtaaaggatatattcgtggtagaattaaacggattcggcgtattttgattcattaccgcattcgagagcaaagacttactcgtcaaattcttgttattctgcaaatcagacaaattagctttttcatccaattgcaattccagttgttggatagtagcgtccaattcttttacagcctgtactaaaacgggtataacagccgtgtaatccaccaagctatcacctgtggaacttaacgtcacaatctctggcataacctcagctacctcctgtgccaagaaaccaaaagctttagaaggtacggcttctgctgatctcaattgcgatgtctcacttttccaattgtaagataccggttttaaccccaatatggttcctaatccactatttaagggagtgatattggttttcaaccgagcatccgaagattgataaaccccctttacttctatataattatactgggagctttctgaatcatagaaaacgacctttcctcctgttcctgagatacgaggattagcgaccgcaacttttaatttcaaaaatgtacccggataatcactcccgttataatacaatttttgtccccacgtctgtatgttcgtgtactgggcttggacactaaacgatacgaataggcatagtatgcctaataaagatacagatcttttcatgatttaaagatttaagttgataatatctattttaacacatcaaaatatccaaccaaataattatttccttttgagataaatatcttataatcaccattcagcaaaaaatctatagaaataggatattctatctcagaagaaacagttatgatgtcattataaagtacatttccttttatatttataattttcacattaagtccatccaataatttattagaatggatgtaaatattattttcatctattgataatgtaggagaagatattatagaacgatcttcctcttcttcccaagattgttcagtatccttcactctattcggatacacaactgaagaaacaaacatcagaaatactaatcccaatataaaacttctctttttcattatctatttttataaacaaaaatagtctctatgagaaatctataagcaaaataggatttacttcttatttactttttgtttacagcgattaagttattataaatcagcgataaatttatccatcatttctgcggtaccttctgttccatgaatctttttatagagacgaatccgggatgctgttattgcaggagtcgagcgtccaactaaccttgcaatgtccttcacgggcatggatatttttatcaaataacaaatatggagttctaactctgagatttgcgggtataaagcatataattgagcggtgaaatttgaataggttgtatcaatctcttttctcaactccttccaatccttattctgaatttccgtatcagtattattacttgtttcatgaaataaccgatagacttcggattttcgaaaagctatttcaagcaaacttttttcattttgagaagtaagaatctttcggtttgatagttctaataattccttttgagattgcacaagttgctttttaaaattatctctttgacactccgattgctgcaaaagttcctctagatatgaaattttcttattattatattcaatacaatccaaactttccgcatattgattctctttcaatagacgtatttttttctccttttcaatcgctgcttttttcttcttttctaacacatatatataacatagactaaagaaaataattaaaacaacaaataatgcaaattgataattgcgaatttttcttttttcattatctattttcaattgaacattctccttttctgtatgctgatacttatataatgagttaacttttgctacagcttccgtttttgtttgattcttaattgaatcagacagttctatacatttatacgcataattcaaggctaatttacggtctccttcttggttttttattttggataagattctatacgtattttttttcatatagatattcccatactcatttgctttctcaaaataatatagagctgaatctatttgcttataactttcatatatacaacctaatccaaaatatatatttgcttgattcttcatacttgaaaccttactgaacaaatctttagccaaatcatattttcccatatctatatagatgctactcaattcccttagtacattatctattctcgattgatcatttaataacaatgccttctcataagcagattgatagtagtatatagcactgtctgtatcttgcttggcgttatagatccgagcaatattcctcaatgcgatcacctctccttttcctttatcatacatcttgtattcatacgatttcctataagcttcgagagcctcatcatacaaaccttgatatgccagtcgatatcccatctgctcataaacccgtcctaatatatcatatcgcttactatctttccctatgtccgcagcatcttgaaaagctctcaccgctcttggggcatctcccatatcccggtatgtacttcctagataataatatgcctccattaattgatctggagtcccatagtcctcataatactgaactattgatttaatcaaagagtctgattcatgaggaatatacagcttatctttagctttaatcttaagcaaagcatggtacatacgtatattttccggctcattcatgattgagctatccaaagaggaaagacagagtaatgcgctatccggatgctcccacataacagattccgcacgagatagttccgcaggtaatggtttttcttggcgcatacaagaaaaaagggtagcgaaaagtagcaaagtagctcgttgggctcataacccaaaggtcgtaagttcgagtcttgcctccgcaacaaaagaaagccctcgagtcattgacttgagggctttttctctattcaatcaagcgatcgggcgatgcgaccccgacggaaacgaataataagctatgcttatttcttccgtaaaggccctttgttcttccagaatcccaatttataatagatataggtgattgtaagcccgatgcaaaggctggcgccgatggcccaccagataccgctccgtccccagatagagctaaaccaataggcgaggggaatgcgtatcagccaaagacaagtgatgcttactgccatcgggaacagggtatcgccagctccccgtaatgccccgttgaagacgttcaagccgccgtgcacgacaaagaatcctcccatgatcaataaatattccttgccaatccggatcacctccgggtccttggtgaaagccagcatcatcttgtccccgaagaaatagatggccgtgaaggttgctagacccagcaataggttgacaagcatggcgaatcgtaccccgtcacgtacccggtccaagtgcccagctccgatgttttgcccgcagaaagcagctagcgccccagagagggtcaataccgcttggatgatgatcgtgtcgatctttcccgctgccccgtaagcggtgagcgtatccgtgccgaaactgttcacgatccccagcaaggcaatcaatccgagcgagatggcacattgctgtacgctggagggaagcccgatgcggagcccttccttgaacagtcccatatcgaacaataaatcctgtttcttgatagagagcaggggatgggtgttgttcacgtagcctagggccacgcacatgccgatcccttgggcgatcaccgtagcccgtgccgccccttcgatcccccatttgaaaacgacaatgaagagtaaatccaaggcgatattcaagatcgtggtaagcaggataaacagcatggggcgcacggactccccgacaccccgcaatatggagataatgctattgaaagtgacgaacaagaacgtaccccctacataaatcctgaaataagcgaccgcctgcgggatcacgtcctccggcgtgttcgtcagcctgaacatcggctcggcaaaaataatccccgctatggacagcaatacccctgcgaccaacatgaagataaagaaagatgagaaggctttttgcaccttatcgaacttcttcgccccgaaaaactgcgagatcaccaccgacgtaccgctcccgataccgatcaccagcgagataataaagtaatagatgaagaaggaagccgataccgccgccaacgactctttccctagaaactgcccgacaatgacgctgtcggtcacgttatagagttgttgcagcagattgccgatcagcaaagggaaagcgaaacgcaggatcaccttccataccgccccactcgtcaaatccctatttcctgtattaattttcaattttcaattctcaattttcaattctctataggtctttcagcaggatattgtcgtttgcctttatcatatcctcacgtgtcttcagcagggctttccattctttgctgaaaagcttgctcgtgtcaatcttgaaattctcggagccatgctcgtccatgcgggtcagcaggtagctgaccgtgatcttattgacatcgattgccggctggtagtatgccacacggtcgtcattcccgtaattcacctcgatgatgatgttcaactccgtgagcaggtataggatctgtgtcgttatgcggatagggatgcggtaagcgtcggatagctcgtcggctgtatagggtttctcgcctttcacgaatcgtttgatgatcagcgaggcgatcagcagggtcaggaaatccttgtaccgacggctgatacttttgctgtccctctcaaagctgaatttcttcacgttctgggaggcgtacgacagctctgcgccaaacaagcaaatcaaccaagaaagctgcaaccagagcaacaacaaaggcagtgcggcgaaactaccgtaaatagcgttgtacttgctcacccaaatctgcccgctgatataaataaattggaacaactggaaggcgcaaccagcgataaagcctgccaccaacccgttcacgaacctcactttcgtattcggcagggagacgtacagccccgtgaaagccaatgtcgtgataatatagggcgctatatgcaagaacaactccatgagcggcgtaaaaaataagtattgccccaagaacgagttctgcaaagtagacatgaagatggataaaccgctggatgccgtcatcagcaccggcagcacgaggaataaggccagataatcggatatcttccggtaccacggccgggatttctggatctgccagatatcgttgaacgtatcctctacggacgagatcaagttgatcaccgtataaaacaataaaatcaaaccgaccccgatgatcactcccccctgcgcctgcgccagatagctctccacgaactcgaacgccttgttcagctccatctcgtgcccggggaaataatcgaacaactcctgccgtaccgtcccttggaaaccgaagcccttagctatacctaataatacggccagcaaaggtacgatagataacaaggtactgtaggtaagcgccgacgccttggtttgcaggttctcgctctggaaaccccgcacggcgagtataaccgtcttgatgatattgatataaatctccttcagcccactaacttcattctcggtaatccgccaaatgtcgtaggttacgaaacggatggttcgtgctaataatgcgctgatccgttctccaataggtttcttttcttcccgtggcttgtttttgggcatatcggcacatgatttaattggcaaaaaaaagcagtctgcctataagccgggtcctgtacctctttggaaagaggcgcctgccatttatcttgtcttaccgtcgccggtaagctttagcggtctaccccccggcatcggacgagccatcctacatgcgccggtatacatgaccttacaacccataagacgtacggcatcccgtatcgctacgggacccggtgagctcttacctcaccttttcacccttaccggacgagtccggcggttattctctgttacgttactctaccctcacggacagcttcccgttaagaagtatggtgctctgtgttgcccggactttcctcacacccgaaggtgagcgacagaccggcagactgcgataggacaaagataggtattttagttgacagttggcggtcggcggttgacaattattttggagacgcataggagagataggataacattttctttttcagccgtaaacatattctgtctcctaggtgttttttatacgaacagggattctagattgccagtaaccgactgtcatttatcgattgccgactgtcagttatcgcatgtcaactgtcaattcgtctgctgtttaattgttaaaaaggtactttgcaatacacagtactgttaagtgcggttaagcccctgtgatgcctcgttaaaagtgataaaaaatacgatggaaatggaatatccgcacaatttttgagttttctttgccgtaaagaaactgttaaatttaagtgtttaattaaataagaaaagtatgaaaaatatctggaagaatgtgcttggtgttgctctgatagcagccattagttctggtgccgcgatcggaacgagtacttacctgatgaataagaatcaacgtccggtggagttggcctccggagttgagaataccttcaagcaaccgtatcgattgacgaattatggaaccgtggccgccgagaatatcgatttcactacggccgccgagagcgccatccacggggttgtccatatcaaggccacggctaacgcgcaagcctctaacggggacggcggtcagcagtatatggacccgttcgagtatttcttcggcttcggtggccgtggagggttccaacgtccgcaacagcaacctcgtgtgggcgccggctcgggtgtcattatctctacggatggttatatcatcacgaacaaccacgtgatcgacggagccgatgagctggaggttaccttgaacgataaccggaaattcccggcaaagattataggggctgatccgacaacagatatcgccttgatcaagatcgaggcaaccgacttacctacgatcccctttggtgattctgagaagttgaaagtaggtgagtgggtgttggcggtaggtaacccgtttaacttgacctctaccgttacggcaggtatcgtgagcgctaagagccgtggtaacatcggcgccggtggcaaggatcgtagcaagatcgagtcgtttatacagacagacgccgccgtgaacccgggtaacagtggtggggcgctagtgaacacgaaaggcgagttagtcggtatcaataccgctatctactccgagaccggtaacttcgccggatactctttcgccgtgcctatcagcatcgccggtaaggtggctaacgacttgaagcaattcggaaccgtgcagcgtgctgtattaggcgtattgatacaagacccgcaatacgtgcccgacgctgagaaagagaaagtgaaagtattcgagggcgcttacgtaggtggtttcgccgagcgcagctccgctaaggaagccggaatcgagaagggtgacgtgattgtagctgtgaacggcgtgaagatcaaatcgtctagcgctttgcaagagcagatcagcaaataccgtccgggcgacaaggtagagttgacgatcaaccgcaacggtagcacgaagaaattcacggtagaactccgtaatgcgcaaggtagcaccaaggtcgtgaagggtggtgacagcgcagaggttatgggcgcagcgttcaaggctttgaacgacgagcagaaacgtaagttaggtgtaagttatggtatcgaggtcaccggtctgaccagcggcaaactgaaagacgccggtataaagaaaggcttcattatcatgattgtaaacaaccagaagatctctgctccggaagacttggaaaagattgtggaaagcatacttcaaggacgtacggaagatcaaggcctcttcattaaaggcttctacccgaacggacgtacgaagtactatgcgatagatcttgccgaataagataaacaaggactgtagtcttataggtgtgaaaagattgttaaaggtttttaattggctggatgtggggtgcatccagccaattctttcaacaaaaatggttatctttgcaccccgtattctcaattaaacaaattgaatgagacaattaaagatcacaaagtccattaccaaccgcgaaagcgcttcgctggataaatatcttcaagagattggtcgagaagatcttatcacggtagaagaggaagtggaattggcacaggctatcaaaagaggagaccgtagggcgttagagaaattgacccgtgcgaatctccgtttcgtcgtttctgtggctaagcaatatcagaaccaaggtttgagtttgcccgaccttattaatgagggtaacttaggcttgatcaaggctgccgagaaattcgatgagacgagaggtttcaagttcatttcctatgctgtatggtggattcgccaatctattctgcaagctttggcagagcagtcaagaatcgtgcgtcttccgttgaaccaagtaggctcgctgaacaagatcagcaaggctttctccaagttcgagcaggaaaacgagcgcagaccgtctccagaggaacttgccgatgagttggatatcccggtggataagatttccgataccttgaaggtgtccggacgtcatatttccgtggatgccccgttcgtggaaggcgaagacaacagccttttggatgtgcttgtgaacgatgacgctcctatcgcggaccggtcgttaatgaacgagtcattggctaaggaaattgatagagcgcttgctacactgaccgaaagagaatgtgagataatcaagatgtttttcggtattggctgtcaggaaatgacattggaagagattggcgacaaatttggcctcactagagagcgtgtccgccagatcaaggaaaaagcaatcagaagattaagacaaggaactcgtagcaagcttctaaaatcgtatttaggctaatttaaggaattattgagttggcgaaggctccggtccgaaaaggattgggagcctttattttttttcttaactttgccactggaatataataccataaaaactatataaatgactacaagacgtaatttcctgaaaacaggatctatttccttggccggcctgttggttggcgagaaggtatactccgccgtgagtacgcccgacaataaaaagagttttagcacgatcgcctctaaggtgaccggcgattacgccagcaagcgcccggctcccgaggcccgtaagtttacctccaaggcggtagaggagcagctaaaggcttccaaggcccgtatcaaggacccgaagctggcttggatgttcgagaactgctacccgaataccttagacacgacctgtgagttcaagatgatagacggcaagccggatacgttcgtgatcacaggagatatccacgccatgtggttgcgtgactcctcggcgcaggtttaccccttcgtcaccttggcgaagaaggataaggacttgcggcaaatgctggtcggagctatcaatcgccagaccgcctgcatcttgatcgatccctacgctaacggcttcaacgaaggccctaccggaagcgagtgggagagcgaccgcacggagatgaagaaagagcttcacgagcgtaaatgggagatcgactcgctttgctacccgatccgcttggcatatcattattggaaagagattggcgatacctccgtattcgacagcaaatgggagcaggcaatggaggccgtttaccgtaccttccgtgagcaacagcgcaaggatagtctcgggccgtaccgtttctcccgtgtgacggaccgccaaggcgataccctcttgaacgatggttggggtagcccggtgaacccggtgggcctaatcgtctcttctttccgtccttccgacgacgctacactgttcggcttcttggtaccatcgaacttgttcgctatcacctcgcttcgccatgtcgcggagattcttcgttccgtaagaaacaacacggatttggccggccgttgcgaggcgttggccaacgaggtggaggaggccgtgaagaaatacgccatcgtggagcatccggaattcggtaaggtatacgccttcgaggtggatggttacggcagccgtgttttcatggacgacgctaacgtaccgagcttgctggccttgccgttcttgggttgcgtggacgtgaacgacccggtttaccagaatacccgccgcttggtgctgagcccttccaacccttacttcttcaagggaaaggccggcgagggcatcggcggtccgcatatcggtttcaactatatctggccgatgagcttgatcatgcgtgccacgacttccaacgacgagaaggagatccggtattgcatagagacgcttcgtgatacggacggaggcacgggcttcatgcacgagtctttccataaggacaatccttccgattacacccgctcgtggttcgcttggacgaataccctgtttggcgagttgatcgtgaagctgcaatccgaaggcaagctgaaagacctcctcggctaatatcaccaaggttaatatcaccaattgtagagacggggcgtgccccgtctctacaagtctgtagctgagtgtatttaggcaaaatcaatcaaaacaacataaatctaagcggaatacatgaaaacaaataaactattcattctgacaggtctggcggcgatagcctccacctcctgtagccaaaaagagaatacgtccgggcagcccgccaagcccatgaatatcctttacatcatgacggacgatcactccttccaaaccatcagcgcctacgacaagcgatacatccaaacccccaacatcgaccgcatcgcaaacgagggcgtacgtttcaccaatagcttcgtagccaactccatcagtggccccagccgtgcctgcatgctgaccggcaagcacagccacaagaacggcttcatcgataacgcccataccttcgacggctcgcagcagaccttcccgaagctattgcgtaaagctggctaccaaaccgccatgatcggcaaatggcacctcacctccgatcccaccggtttcgattactggaacatcctcgtaggccaaggcgattactataaccccatcttcatcgataacggcgagaagcgtcagatcgaagggtacgccacgaacatcacgaccgatctggctcttgattggctggacaataaacgagacaagaacaagcctttctgcctcctgctgcaccataaggctccgcaccgtacttggatgcccgatacctgcgacctgcgtctttacgacgatgtgaccttcccgctgcccgagaacttctacgacgattacgccggccgcatcgccgcctcggagcaggagatgagcatcatcaaggatatggatatcgtatacgacttgaaaatggccgataaggagaacgagatccattcctccaacgccgatctggagaagtacggccgtgagctttataaccgcatgaatccggaccagaaagccgcttgggacgcctattacgatccgatcatccaagacttcaaggcgaagaaacgcacgggtaaggagctggctgagtggaaataccagcgttatatgcacgattaccttcgggtgatccattccgtggatcggaacatcggtatcgtgctcgattatctggagaagaacgatttgctggataacacgttgatcgtctacacctccgaccaaggcttctacatgggcgagcatggctggttcgacaagcgcttcatgtatgaggaatccttccgcaccccgttgctgatgcgtctgccgggtggcaagaagggtgatatcccgcagctcgtgcagaatattgattacgcccccacttttttggaactggccggagcccccatcccagccgacatccaaggcgagtccttgcttcccttgctgaaaggcgagcggccggagaactggcgtaactccctttactatcattactacgagtatcccgccgagcattccgtgaagcgtcattacggcgtacgtgacgatcgttataaattgatccatttctacaacgacatcgacgtatgggagctttacgacctccaagaagatccccacgagatgaataacctttacggtaagcccagttacgaggcagtgacgaaacgcatgcgagacgagctttataagctgcaaaaacaatatgatgaccccgtgggaatacgcttcaatgtgtcggactgatgagagcggacattcgtgttctgttatcagattttttaattagttgtggattaaggtgtataaaggacttggaacttgggggatgagaagttgagtctttgcgcttgatgacttagctctttgcgctctttgatttaagtcattggctcgaaggaattaagtctatcgtatggctcttctttgcttatgcgtgtatcgaattaaaaaatgactataggcaggtttcaagtttcaaggtttcatgaaacctttttcttcacacacacgatgcgtacattatataggtttcaaataaatccctttatgtttgttatgcgggatggatagcctcgaagaacttgcgtagccacgacatgatgtttttacccgaggcggacggagcgatcatgaggaactgtattatatgtacttgtgcgtgtgtgaggaaaaggggttcgtgaaaccttgaaacttgaaacctatttccatgcccatccagatattgtcaacatcagtacagataaatatatgtgcctttatcgtgtgcgtacattaaaagtaaggattgttgagccatgagaaaaaacttgaaaaataatgccgaaaatgtttggaggttatgttttatagcgttacttttgcacccgcattcgagagagaacggcgataccaaaataatgaaacaaatttttcttgaaaaaagttctgaaataatttggaagtttaaaagaaaaacacttatctttgcatccacgttcgcaaaacgatagcgagagagttctttgagagatttacataattcaacaagtagtacaaacggacagccaatctcaattgttaaccttaaatctaataccatgaaaaacacagtacaaatataggtggttttatgttatgtagcatactgaattatttgcaaaattcattcgcttaactcgatttaacgaaatcatgccctaaaacatagttattaacaagaaaactattcgttcagatctaatagcttcccaagaaatcgtcgagggaacgagtatcatcatctggcatcaattcttttttcaaacgaaatttgcgtttatagatagcatccttcgtcacattcaagactgacatcagctccgccgaggttagccgcaatttgatcaagcaacaaaaacgaatggcatcctccgtcaaatccggataagcgacacgtaaacgacttataaaatcatcataaagagtatttacgatctcgatcaagtttctccaatccgaatccggcaatatcgtttccgatttagaaagtatcttcaacttcttgaacgtatccaactgttccagcaaacacttcgccaaacgttccttttccttgatcaaggattccacgtcacgatgcgctttccactgagccgcatgctggtattccatcaagcatttctccttcgcttccaattgctccttgatgtgcgacatctcacgactataacgttgtatcaagatttcatttttatccacaagactcgctatttctctcagttctttctccttttttgtcttataaaggtgataacgcaaaaaagataataaaagtagggcaaaagtaacgatgattaaaatgatcagataataaatatctacatagaaatgctccggctcctttagaaccgagcttatggcagtagatgtgtgcagcgcaaacttcatataaatagtatttattatcttaatacttctttcttagaattccctctctccaaatcgcttccaaaaagcctgtcccatatccgatcaattggacaaaagccgctatgatagataacaacgcaacgattccgttcttatttctcactaaagcgtcaaaaaagatcagcgaaatataaaataacaatagcccccatacctttggaacgaaaaaagcggaaatacatacccccagcagacctaccacaaataaggccggcaggcaatgtacccatttcaatgattccgggtacttctggtacaagataatcctagcgtaccccgaatgccatacttgccggaaaaactggacgaaatttgttcttcgcttatgatagacccaagcgcccggaaaataacggcatttatagcctgccgcaaaaatccggatactaaaatctatatcctctccataacgcatatcagagaaaccacccaaggcttcatacacctctttccgcattcccatattaaaactccgaggatagaatgtatccaaatgtctccggcttcctcggatccctcctgtcgtaaagaaagaagtcatcgagtaattgaccgctttttgtatagcggaaaaagaagaatgcgccctgtcggcaccaccaaaggcatccaccttataacgcatcaaggactcgtgtacttgttccagatagctggccggaacgatacaatccgaatccaagacaatcacgatctctccttccgcataacgtaccccttgattgcgagccaagcccgggcctgaattctctatatagaaatagcgaatcctcaagcggtcattataggcattgactacgggctcacaaggtatagaagaaccgtcgtccactacgataacctcaaaatgtacatatgtctgccgggtaaggctgtttaataaatcgtctatctcctccggacgattgtagacaggaataataattgaaaatacttccattaagctagatttaatctgccgacaaaagtaaagagttaaaaagcgtgtatcaaaaaagggcactggacaaatagaggacatagctggacatcgaataccgcctattttttaccccataatagaaaaactggacaaaagacataagatacgttcagttcattcatacggaatagtctatttatcaatagcttacaaaacacaatactacccgctactatttggacaaagactggacgcacacaatattatttcattcgcacatctgccccccacattaatttttcccgaagcgtctgataaaaagtatggttatagcgcttgatgactttcgtcgtataatcggccttgctcatctttaattcgatacctgccgggaatatttccgaacgtccatccaaagagatcagaaaatatttattccggctctctacccgaagcgttattatatctgaatccggaatcaccaacggacgcacgttcaaggaatgcggagcgaccggactcaagacaatgctattactttgcgggacgataatcggcccatttacgctcatcgaataggccgtggagccggtaggtgtagccactaccaaaccatccgcctgataagaagtcagatattccccattcaagaatgtatgaatcgtaatcatcgaggaactatcacgcttcagcacggcgatctcgttcaaggcataattatatccgcgaaacgcacggtcttccgtatataaacgcaagagggttcgttcctctaccttatagtaattcttaaaaatctcatccagcgtatcctcaacctcattactgctgacatccgcaaggaaacccagccgtccggtattaatgcctaaaatagggatatcctgtttatttacccgggccgccgtacgaaggaacgtaccatctcctcccacgctaagggctatatccagatcaaactcatcacccactaatagcccgctcaccactggctcaaaaccaaaagcatcggtaaggaatgtataaaaagggctgtccacataaatatcagcctcttgttcacgaagcttctcaaacaggcgtttaatcagattctgtctctcgatctgatattcacttccaaatattccaactttcattttacgctccttactttacatattcatataatgtaataactcattcatccgctgccgcaacatatcatccaccatccccttctccataaaatgataaagcaccgtataattgaaacgctcgaaactacggatcacgggagaggcatcttccaaatcgatcttaagggttataagcagacggcccgtatctttatcttgatgggatagcaaattaaggacatgggcattattcgcctctaccaaacgggcgatatccgttaatgaataatcctgtggcatcatttccaatacgatcacgcttccagccgcctccgcattacatagctcggataaagcatccaccaaacgatcccgggtaatcgcccccaaataagttccgtccacggaaaccacaggcaacaggctcaatccatatcgggttatcattgccaacgcttcatgtaaatgtctattttccgaaatcgccggagcgaataaaaccggctcaccgatcgtagccgaaggatccggcagcgccaataagtctttttccgacactaaacactggtatgcgctatcactcaataacggaagatgcttgagtttaaaatcctccattaacgccaacgcatattccgctgtgtcaaaactttttaacaccggaatttcctttgttatgaaatctttcaccaacattattctgttaattccctaaatcctgctaaatttgccgatacttttgtgcaaatgtaatgaaagaaaaaagatatacgatatacaatgacaaatttaagtgtaaacattaacaaggttgctactattcgtaatgcgagaggtggcaatatgccaaacgtgctgaaagtagcgcaagactgtgaattattcggggcacaaggaattacggttcatccccgtccggatgaacgacacatacgctatagcgatgtttatggactaaaacctcttatccggacagaatttaacatagaaggctatccttgtgataaattcatcgacttggtattgaaggtaaaaccgacccaagtcacactggttccggatgctccggatgccatcacgtcgaactcaggttggaacgtaaaggacaatttcgattacttaagcgaattggtagacacctttacctcacaaggaatccgtacatccatcttcgtcggaacagacttggcgaatatcgaactagcggcgaaaacaggtacggaccgtattgaattatatacggaaccttatgcgacctattatccggaagatcgtgacaaagcgatcgctccttttgtcgaggccgcgcaattagctaaaaacttaggattaggcgtaaatgccggacacgatttgaacttagaaaatctggctttcttcaacaagaatatcccttggctggaggaggtttctatcggccatgccttgatttgtgatgcgctctaccatggtttgcaagagacgatcgctttatacaaggcatgcttgaatagttgacaagtgacagtttatagttataaatcataaattataattcataattcgaaacgatgagtattttactttcactacaggccgtgggctctcaggcggcagatcaaatgccggatttaacggctgtaacccttcctacggaagcggaaatcaatgtgatagaccttgcctttaagggaggttggattatggtggtattgttactgctctctctgatggctatttatatttttgttcaacgtctgatcatcattcgccgtgcgggaaaagaagacgagacgttcatgaatcgtattaaggactatatccatgaaggaaaagtggactcggctctcaatttatgccggagcaccaacacaccttccgcccgtatgatcgagaaaggcattacccgtttgggccgtccgatgaacgatgtgctcgtagcgatcgagaatgtcggaaatttggagatcgctaaactggaaaaaggtttccccttgatcgcgacgaccgccgccggcgctcccatgcttggtttccttgggacagtaaccggtatggtacgtgctttcttcgatatggcaaacgcaggtaccaatgttgatgtctccttattatccggtggtatctatgaggccttggtgacaaccgtgggtggtctagtagttggtattattacattgttcgcgtacaactatctggtatctcaagtagataacgtcgtgaacaagatggaggctcgtacgatggaattcatggatttattaaatgaaccggctaattaattgaaaatggagaattgaaaattgaagatgagccaactctcctctatttaattttcaattctccattttcaattttcaattataaaaaattatggctctaaaaagaagaacaaaggtaaacgaagcgttcagcatggcctctatgaccgacgtcatattcctcttgctgatcttcttcatggttacctctaccgtagtaatcccgaacgccatcaaggttaccttgccgcaagcgcaaaagcagacagcggcgaaacctcttacgagggtaacgatagacgcgaacttgaattactacgtggcatttggaaagcaaaaagaggtacaggtctcatttgatgagatcactcctttcttgcaagatagttacgcgaaggaaccggagatgttcgtcgccttatatgccgacgagaccgtaccttacaaagagattgtaaagatactgaatatagcgaacgagaataaattcaaaatggtgcttgccacccgtccgcagaaataacagatatgagactgaataaggatgacatatacagtttgatcggtaccgttgcttttcacggtgtcattctactgatactttggtttaccgtattgaaaaccgaggtaccggatgaagacgggggtgtactcgttaatttcgggaatgtagatgccgccgccggaatgttcgagcctaagtataccgggcaagaaccgcctcaggaaacgaccactccccctcctcccgtaccggagccgcaagtggaaacgcccaagcaggaactcatcactcaagatatcgaggaaagcgtagcccttgaggacgctaaaaagaagaaagaggaagagaaacgcaagaaacaagaggctgagaagaaacggaaagaagaggaggagaaagaacgtatccgccgggaagaagccgagaagaaacgtctggccgaggaacgccgcaagaaggaacaagccattagcaacaaggtggccggagcttttggtatgggaaacgccgagggtaacagccaaggtgacgctgaaaacggaaccggtaaccaaggaagtccgttcggtaactctgatcacggggcgaatgaaggcgtaggcggttacggatcatttaatttgaacggccgttccattggtgccggaggtctccctcgtcccgcttacacgatccaagaggaggggcgtattgttatcaatataaccgtagatccgaaaggcaacgttatatttgccgaggtaggccggggaactaatatcgacaacgcctccatgcgtaaaagcgctttggacgcggctcgaaaggcgaagttcaacagtatcagcggcgctaataaccagagtggtactattacttacgtgtacaaatttaaataattgaatcttatgaagaaagcgatcgtattcttagcgaatggcttcgaggaaatggaagccacgggaaccgtagacattttgcgtcgcggaggtatagacacgaaaacagtctccatcacagacgaccgtaaagtggtgggtgcccatcatatggaatatatggcagatgccctactttccgaaactgatttttcaggtatagacgccttgatcttaccgggaggtatgcccggagcatccaatctaaacgagtctgaggcggtaaaggaggccttattgcaacaatatcgccaaggaggtatcgtagccgctatctgcgccgctccaatggtattgggcggtcttggcttattaaaaggccgtaaagcgacttgctaccccgggttcgaaccgaaattgattggtgccacggtaacaggcgaggctgtcgaggtagatggaaatgtggtaaccggtagaggaccgggcttggtattcaattttggcctagctttagtatctgtactaaaaggtgacgcggttgcggaggaagttgcggccggattactattataagatttagatcatcagtcgaaacccaatagaatagggaacgtaatccattgagttatgtttcctattccattgagttttatcacctatcctattgacttacgagatatcccccaaagagctcactgccctattctattttgatcgtttcaaccgcttgtcgcttcgtcccatccatggataccgcacgataacgaaccgtcgagaaatcaatggaacgtaaatctatattccgaataacgctattgtacatcgtacggtaataaatcacatggtttcgcatatccgtagccgaagtccattgagtagcgctcggtatatcgcaaggtacttgccctaatgggaattcgatccctacgggaatatcaaaattattcaatatttggaaacactggaagaccgtttccaatgcggtttcttgttgtggggccgaagcttggtaaaaagccgcacgaacgaaacgtgacggtggagttacgtcgcccggaatcccaaggaaaccgcttcccgcaccaaatgaagacaactcgatatttcctaattgttgattgggggccgtacccgggaaaagattaacataattattcaggttcgtcagatgccactcgaaactgggagaattagtcagaactcctaacgtattctcatagaagtgtagctcacccttaataatctcaagaaccagttgacgccccgacggctcggcaaaccgccaatgaacggtagacgcacggggatctatattgataacatgcactttcttaacagcctctttcacctcctctacatttgaacattcccccaacagccaagacactaattgcagatcagagatacttttatcccgaactgcggcattatatttctcatattcaccgtactttggaaaataaaacaatccagccgataacccaacctcattgagtccttcggcgataaattccttttgctccactgccaagcccacatatccataacgtgccgtgaaagtcattccatcaaccccatccggggtatacgatcgttcggtgtatcctcttggaaccacgacatactggctgttcaaattacttccaccccattctatcgtacgtgctacaatagtcgtactgtccttgctttttaaggtaataccggtgcaagcctctgcagcggaaggattaataagcaagccggcaatcgcaaataaaataaagaaatgtctcataaacatcatttttgataaaaacaagcgacaggagaaggttgttttcaagatttcaagacttttttgtatgtttgcggtcattttatcaaaaagtataatatgaataataatctaaaaggtttcgcttatggaatagcgacttctgttacattcggtttaatccctttgtttacattgcctcttatggagaagggtatgcggtttgattcgatattgttctatcgtttcttattcgcagccatcgccttatcgggtatgcttctagcgaaaaaggaatcttttagaacagagatgcgaaacctaccgatattgattttattaggcgctttctatacaggttcggctatgttcctgttttggggatataattttatggcggcaggaatcgcaacaactctacattttacatatccaatatttgtaacccttttcatgctttttgtatttaaagaaaaaacatcatggatcacgcttttagcgatcggactcgctatttgtggagtagcccgcctatcaatcgatggaggcgagatgcaattaaacgggttaggcgtgatcatcgtattactttctgcggttgcttatgccctctatatcgtaaccgtcaataaatcaagggtacatgatatgccgggacgaaaacttacgttctatgtatttatcgtcagtacctctttatttttcataaaagcacaggcaggaacaggaatccaacccattccagacctgccctcttttattaacctcgtcttattagccttcttgccaaccgtagtatctaacattacattggtacaagccgtacaccatatcggttccaccctaacttccgtactgggagcaacagaacccgtgacagccgtctgcgtgggtgttttagtctttggagagcctttcacccctcacctcgctttaggaatcttactgattatcgtagcggttacattgattatcctgtccaaatacatacagaaaaatctccatgaggccaagcgattgttcaaagcacggcacatcttaagaaccaaataacaatacaactgaaagcaatacggcatagataaatacattccgtgccgtatgccctaaagttctattaagctcacggccttgatactgtttcatctccagccatgtggcggcaaacagcacgctaaaagccgcgaataaacaaacaagccaaggtgaggcatccatcaataaaggaagagttatcaagacagcaaatataccgttcagcaaataagttaccaacccgaacgtacgcccgaatagcacaatcgtagtccgtttacgagccgccttatcttgctcataatcccggtaattattcacgatcaaaatattagcggacaacaaccccaatgacaacgaaagcaagaatgacaataaggaaaacgataatgcttgtacataatacgtaaaacaaaccggaataatcccataaaacaatacgacacacacatcccccagcccgttataagccaaaggaaacggcccagctgaataagccaagacacaaatcgcgatagcaattcctacaccgatgagctcccagccggcaaagaacaacaagaaacagccacatagacaagaaagccccaacgtgataaaagtcccccatagcattgccttaggagttatccaaccggaagccaccgctcgctccgggcctaaccggtcctccttatccgcccccttcttaaaatcaaaataatcattggcaaaattactggctatctgggcgagtaaagccaccaaaacacaaaggatcgccggagccaatttaaatactccatccctgtaagccagcgcacacccaactaataccggactaaatgatgccggcaacgttttcggacgtgccgcctctaaccaagcttgaattctcgatctgttattctccattctattgttttattcttaaaataactacaaaaataaaaaacaaataacatatactattgttattatctaaagaaatacttgtatatttgcgccatgaagaattttctattcatattaggtctgttgattagcttcatgctgtttgttcccgaagaagggacaaagagtatggatgaggttatgtctgcgactaaagaggccgttatgaaagaaaaaaacacggcagatgcccaacgtcgtttcgaagtattaagtaacgagctgaaaagcagcaactgcttaactccccgcaggatttcacaaacgacaaacaacactatcgaaatacggatatggaaaaatatggagaaatcccttcaagacatgcgtttgagaggagtaaatcaacttcatagagtatctcaacatatatccacttatcagatcgtaaatctatccacacttctgtgccgtatgggagagcatatctttaccctgcggaaactcattatttagtttttaattgtttcatatttgtatctttcgacaagtctttagtatgtcttgtctgtaggaatattgtgtttattaaatcaatattcccggggaattataccctatttacattattataaacaattaaaaattacaattatggcaactaataaatcaggtaaaatacgtatatatctttatgttcttctaacaatcgcaggttgtgtattcgcatgcagctccatcatccctaacgactatattaaattagtagtagttatgggcactttatgtgttggtctatatggcataatgaaaggactgagtagtaccgggacgtcatcggaagaagaagtcttggaaaaagaataataaatacaacaattatcgaaccctaaaaaatcaagaagatcatgaaaataaataaagacttggtagatgcggtcatgatggtttcatttatcgtattggtattagtaggaaccacgacatttgacaatgaggttgctaaagatgtaaccatgggatccctcggtgtgattacggtagcgatgttagttcttcgcgtcataggatcacgccaaaaggaagaggaagaagccttttagtagttagtccattggtttcctgttgttgtcccggggtgacccgggattatctgagatacgtttttctacctacattataataacttgctgtttgacttgggtatagcgtttttacgcttgacaacaggaaaccggacttatataccttacacttttcgactgaactttttctctttgacaagactaactgcggcagcggcgaaaaacaagaaaacacctcccgttaacaaagcgaacacggcatgcccatgataaacattacgtacaatccatccatgaatgattccattcgtgatctgaggtatcgttataaagaaattaaatatacccatataagtacccatcttatctgcgggaagactatcggaaagaatagcataaggcatcgccaatatacttgcccacgctataccgatgccaatcatggaaaagaccatcattcctgtgctattcaacaaatagagagaaaccagccctgcccctcctaggcataaacagagggcatgagtcattttccgacctaaatgacgggcaatcgggatcaataataaagcgaataacatcgccacaaaattatagatactgaataactcacctaccttatcgccagccatcgcatattcggcggaagcaggatctgttgccccatatacatgttcagcgatagcaggcgtagaataaacccacatggaatacaaggcaaaccaagcgaaaaactggcatagacctaactgtaacattattttaggcatatgaaagatatcatgcatgatctccataaagccattgctatcccgccttttttcaatgacctcaccaccggaaagccgaaactcagccatctcttccggggaatattcctttgtcttaaaaattgtccataatacgctcgctaataaaatcgccgcaccggcataaaaggcgaatttaacattatcggcaacctcaccagcaaccgccgtattagataaaccaaacaccttattcataatactcggcaacaaggaaccaacgacagcaccgatgccgatcaagaaagtctggatcgagaagcccgtcgtatgctgctcatcgggtagcatatcccctaccaaggcacggaaaggctccatcgttacattgatggaagcatccatgatcatcaacatacccgcaccaatcaatacgggagataaaatagccgtctctgtaccgggtgacaagaacaatcccgcattcggcatcaatatcaaggcaatcgtcgtaaagatagctcctaccagaaaaaacggacgccgacgtcctaaacggcaccaagtttggtcggaataatgaccaatgataggttgtatgatcatacctgtcagcggagccgctaaccaaaataaggatagttgctctacatccgctccataggtttgaagtattctacttgaatttgcgttctgaagggcgaaaccgaattgaatgcccaagaaaccgaaagttagattccaaatttgccaaaaactcaaaaatggttttgttttcatgagaattatgttttttaaggtatttatttgtttggtgacaaacatacggaattattccgaaacaggacgtcgtccctattcaaattcatgcaaagaagtaaagcaaacgttttcggaagccacttttttaacgggtagactgtctcaccaccagatttgtcttgataatcttgctcacgatacgatccccgtcacgcacgccattcaaacgttctatcagcaaacgcatagcgatagctcccaactcataaccatgttgatccacggaggtcagcaggggatcgctaacttccgctaagctattattcgtaaacccacaaatcgaaacctcatcgggtatcctcaatcctttggccttgacaacattcagcaccccaatagcggtctcatcatttacggcgaagaacgcatccggacgattgggcaacgacaataattccggggtcaaccgaagcgcctcggtataattatcacaaatcttaattaactctttatccaccggtaatccatttttacgcaaagcatcctcataccccatcctacgattattagagatcgctaaatgagaaggagatccgaaaaaggcgattcgccggcaaccgctacgaatcaagtattcaacagcggaacaaaccccggcataatcatcaacgaccacccggtctgtcaagatccccgtgcatatacgatcgaaaaacaccatgggtatatcgctatcgattagttcttggaaatgattgtagatcgtcgtcgttttagcgacagaagccaagacaccgcaaacacgtgcttccaataaagcttgcgcaccttttacttctttctcataattctcattactttgacaaataataacacgataccctcccttttccgcctcatcctctataccggataaaacagaagaaaagaaataatgtacgatctgcggtaaaataacaccgattgttttcgtattatttgtccgtaaactcaaggctaaggcattgggcttatatttatgttcacgagcgtaagcattcactatattcttggtttcttggctgatatccggatgatcagccaaggaccgagagactgttgacggggaaatatgcaaggctttcgctatatcctttatcgtgatttgacgctttttcatggttctcttttttataaaatcaaagatatgtatttaggtcatacaatgcaaacgtttgcgagaacgtttgcgtaaatttataggggtatcgacaaacattttaacaacatgagaggtttgataaacatacatttgcattcatatactatggctaaaattcaataaatataatagagtattaatcttaaactgtctaatgcatgaaacaaaaaatgtattcttgcgacgcaagagtaatcttatctatcttgataggattgtttctctcctgcaatgttttcgcacaagacgtcacgatcaaaggcaacgtgaaagacgcgaaaggtgaacccatcatcggggctagtatccttgaaaaaggaactacgaatggaactgttaccgatttcgacggtaactttatgctctcgacgcctaaaggaagtacgatcggtatttcttacataggctacaaatcacaagacattatcaaccaaggacaaagtaatttaattgtcgtattacaagaagatacggaagtattggacgagattgtcgtaatcggttatggtacggtgaagaaagatgacgctaccggttccgtgacggccattaagccagataagatgaaccggggtttgaccactaccgcaaccgatatgatcaacggtaaaatcgccggtgtaaatatcacgactgacggtggagctccgggttcgggagccagtatccgcatccgtggtggttcttccttatcggccagcaacaacccgctgatcgttatcgatggacttccgatcgacaatgacggtatcaaaggggtatccaacccgttgagtacgatcaacccgaacgatatcgcaacattcaccgtattaaaagatgcatccgccacagcgatctatggttcgcgtgcctctaacggtgtgattcttatcaccactaagaaaggtgagaaaggctcccgcccacgggttacgtacgatggaaacgtttctatcagcacgaagaccaaatcaatcgatgttatgggagctgacgaatatcgtaatttcgtaacggatcgttttggggcggaatcaagcgccgttaagttattaggaaaagaaaatacggattggcagaaagagatcttccgtacagcagtgggaaccgatcataatatcacggtgtccggaggcttgaataatatgccttatcgtgtatccgtcggatatacaaaccaaaatggtatattgaaaacctctaagttcgaacgttatactggatctgtaaacctagctcccagtttcttcgaagatcatttaaatattaacttcaacgccaagggaatgatctcaaataatcgtttcgccgatacgggagctatcggagcggcaatcgcattcgacccgactcaaccagtcatgaacggcaacagtaaatacggaggttatttcgcttgggaaaatgccggtgaatttatctcaatcgctacaaaaaacccggtagcgatgcttcaacagaaaaaagaagaggctaattctaaaaacttggtcggtaatatccaagttgattataaattccatttccttcccgaattacgtgcaaacttgaatttaggtatggatatggctaccggtacgcaagacatttactatccgaaagaatctccattaggttacgtggataacggcaaaacaggttatgagacaatcgacaaatacaatcacctattggatttttatttgcaatacgctaaggatttcaatgaaaagcatcattttgatatcatggctggttactcttggcaacatttccatcgttccacagagaacgcatacaataacttgaacggagataacccgacttcttatattttcaagacagaaagttatttgatctctttcttcggacgtgtcaattattcattcatgaatcgctatcttatcaccgctaccttacgtaacgatggcacttcccgcttctctaaagacaaccgttggggattgttcccttccgtggctttaggatggaagatcaaggaagagggctttatgaaagacgtggacgctgtatcggatttaaaactacgcttgggttatggtattactggtcaacaggatatctcgcaaggagactacccgtatatggcgacttatttcgcgggacaagacggagcctactatcaatttggcgaccaatttgttcctatcgcccgtcccgacggttacaacccgaacttgaaatgggaggagactactacttggaacgccggattcgacttcggattcttagataaccgtatcacttcatccttggattattattacagggaaactaaggacttgatcaatgtgatcgacgtaccggccggaacaaacttcaagaaccgtatcgtcagcaatatcggttctttgagaaatcaaggtgttgagttctccatcaacgctaaagcgatctcaacctctgattggaaatgggacctaggctttaatgtcgcttggaacaacaacgagattacgaagctaaccgcacaggatgacgcctcatccatcgtattgacaggaaccgtagaaggtggtaccgggaccatgatacaggcacaaggtgtgaatcacccggcgaactcattctatgtatacgagcaggtatatgatcaacagggtaatccgatcgaaggattatacgtggaccgcaacggagatggtgtgatcaatgacgaggaccgttatttctgccataaaccggcagccgatgtaacgatgggctttacttctaaattggtatggaaagcatgggatttcagtttctcacttcgttccaacctcgggaactatgtatataataatgtagcctcatccaatgcggcattaagtgaaggtagtattaacaataaaggctatctatccaaccgtccgctatccgctttcgatacgaatttccagaacatgaacgtattgtccgattattatgtacaaaacgcatccttcttacgctgcgataatatcacgttgggttactctttcaacaaattattcggcgtattgggcggacgtatctacggaaccgtacagaatccttttgttatcacgaaatataaaggattggatccggaggtagcgaacgcagctgataagaccttcggtatcgataagaacgtatatcctcgcccattggtaggtatactcggtgtaagtcttaacttctaattttaaatcaggatatctatatgaatacgaaattctttaaatatataataccggctttatcgctggttttcagcgtaaacttcacctcttgcctaggtgatctcgatgttacgcctatcgatccgaacctaaacgtagagttcgatcagaacgccaatttcgccaagatctatgcgggattagccatcacaggaaataaaggtcccgacggacaaggagatatcgccgacacggatgagggagcgtcgggtttgatgcgtatgctattcaacctgaatgagcttcctacggacgaggcgatttgcgcttggtctggcgacgtggatgtatatcccttgaacttcgctaagtttaccgcctcgaacggtgtggtattgaatatgttcaaccgtctgtacatccaaatcgctcagtgtaataacttcttaatacagacagagggcaaggatgacgaggaaagtcttacacagcgtgctgaagttcgttttatccgtgccttggattattattatttgattgatttatatggcaatgtcccgttcgttgatgagaacacgggtatcggtacctatgtccccgaacggattacccgggcgaatctctatacctatatagagaaagagttgaaagaaatcgagccacaaatgaaggccccccgtgcaaatgtatatggacgagccgatcaagccgccgtatggatgctactttcccgcttatatctgaacgcagaagtatatacaggtacccctcaatggtctgccgccgctgaatacgcaaagaaagtcatggacgccggtttctctctggctcctaattatggagataatttcctcgcagataacaacacctctcccgagatgatcctgccgatttgttatgatggcgtacagactcgctcttggtccggattgttctttatcgccagctttatcagtggtgacatgaacgcactggatgatttcgggactaaagaagcatggggtggtaaccgtgcccgcatggcattggtgaaaaagttcgcttctgatggagacttatcgaaaacagctgatacacgtgcctctttctggactacagaccgtacattcgagatcaataagccgaccgagtttacagaaggttattctgtaactaaattcaagaatatcacgaaatccggacaaatcggtcacgatccgaatcagcagttcccggatatggatttcccattgttccgtttagccgaggctaatctgaccttcgccgaagccacattacgggcaggaggcgataaacaagccgctttaagcgctattaaccaactacggaaaagagcgaaagccacggaaattacggcaaccgatcttactttggattttgtgcttgatgagaaggcccgtgagttctattttgaggcgcaacgccgtacggatttgatccgctacaataagttcacctccaattatacttgggattggaaaggcgagacagcgggaggtacttcaatctccagtcacttctcattgttaccgattccttcgacccaactcgtggcaaacagtaacttgaaacaaaatccgggttattaatcgtaaaacctattaataagtaacaattatgaataaagtcaatatattatccatcgtgtttgcgggcatctgtgctttttctgcctgcacggacgataaagatccggttatcaatgacctaaaggactcagaaggtaataatatatcttttatcctcaatgctccgaataatagctcatatactttaatgccggaaaatgccagtagtatcatcgatatttttacctgtgaacaaccggattacggttttgcggcaggtgtaacgtataccgtacaagtctgtgaaggaggaactgaattcgagaaattcgagtcgctgccgactaccggttccggcgaaaaagtcttgatcaagacattcgagctgaatgatgccatgaacaatttgggaatggttaatcctaccgtagcttataatgtggacttccgtcttaaagcatttattaacgacagtgttcccgaactttattcgaacacggtaaacatggcgatcactccatatagtggcgcccgtacccaagtttatttcgtaggtgacatattcgacaacggatggaacaataacgacccatcgatgcgtatattcgccgacgacgatgttaataatatgttattcacttacacgggcttcgtaaaagccggtagcgcattcaagatcattcaaaccccgggtgattggggcattcaatggggttacgacagcgacggagcattaagcaatgacggcggtagcggtaatatcgaaggcttcacgcaggatggctattatacgatcacgttagacttggctggtaacaaatacagcatcgaaccttataccggagcgacaaccgaatacaaacaaatctccctgattggagacttcaatgattggggtggtgatctagatttacaacaggctagttacgacaagcacatctggatcggcgagaaaatagagattccgtccgatggcggtttaaaattacgtgcggatcatgactgggccgtaagcttcggtggcagcaatagtttatggaacgataaacaaggacaattcgccaaatttgacggaggtgataatgtaaaggtttccgccggtacctattttatcaagtttaatgacttaacgaaacatatcattctactagccgaataaggcattacttaaattaccatcctttacttgatttaaaagccaagtaaaggtggtaatagataaaagtaacgcttgtgtttatgaattatgtctcaaaagatatgttttagaacatgattttgttaaatcacgttaagcaaatgagatttccaaactattcgttatgctacataacataaaacctctatatttgcactgtgtttttcatggtattagtcgaaggtttaagtaagtttttccgtacggaagaggttgagacaattgcgttgaataaggtttctttggaggtaaaagatggcgagttcgtcgctgtcatgggaccttccggttgcggtaagtctacgttgttgaatattctgggtttgctggataatccttccgagggaaattattacttgggcgaccaagaggtaggacacttgaaagagaaagagcgtacgcaggtccgtaagggaaacatcggtttcgtgttccagagcttcaacttgatagacgagttgaacgtttttgagaacgtggagctgccgttgacttatctaaagatcaaggcgtcggagcgtaagcagatggtaacggatatcttgaagcggatgaatatcagccaccgtgcggctcacttccctcagcaactctccggaggtcagcagcagcgtgtggcgatcgctcgtgcggtagtttccaacccgaagataatcttggccgatgagccaacgggtaacttggattccaagaacggtgccgaggttatgcagctgctcaccgagctgaataaggagggaacgacaatcgtaatggtgacgcactccaagcacgacgcgggtttcgcccaccgtgtgatcaatttattcgacggtagcgttgtttcttccgttagtgaatttatttagtcaacatgacataaacacatacacacaagagttttttataagctaattggcctgtgaaggtcggttagctttcaatttaacttaaatacaaatcgatgagacagctatattatacaatccgttatttacttcgaggccgagggggaaatgtgatcaaggttctgtccttgacactaggacttggagtgggattgatcctgttcgctagggtcgcttttgaattgagcttcgatacattctttgaccaagtggaagatttgtatagcgtgcatgtgcgatacaatgatgataaaacgggagaggaagatgggtctcgtatcctatttgccccgatcccggaggctttgcggcaagagttccccgagatacagtatgcgacggtttgccggagaagatacggagccgtattgtatcatggtgaggatcggttcaagccccgtttgatgatggcggattccctctttttccgtacgatgggaatcaaggtgctaagaggggatgaccgtttgttgggaatcgaagatcaagttttcttatcggaaaaaatggctgaacgtatatttggcaaggaagatccgatcgggaaacaactgctgtacggaaaaaactatccttatacggtggccgggatattccgtgacataccggaaaatagtcatttacgttttgacgctgtcgcttctttcattaatatgaaaacccagttcggtgcctatgccggttggggtgccgacgatagttatctgggctatatccgcctgaaaccgggtgtgttcccggaacaaatcaatcagaaaataccggctttattgcctaaatatatagatgtagaaagagagaggaaacaaggttttgatatggagctttatatcaagccggtctcggagatatatacgcaaagtaccgaggtgaagcggatggtggtgatcatgagcgtactggctttcgctttgttattcgtggcggcgatgaattatatcttgaactcggtatcttctctgccgatccgggcgagatccgtaggagtacacaaatgtaatggagcttccagcaaggacattttcaatatgttcttgtttgagacggcggctttatttgtagtggctcttgtatgtatggcattgcttttattcgctttccgggaatatgtagcggatatggcggctgttcctacttggggcactttattgaatgcgcagactatatggcttcctgcgatcatgatcttggctatattcattttgtccgccttgctaccggcccgtttgttcagcgttatcccggttacccaagtattccgggtatctacttcgggtaagcagggatggaagcggagtttgctctttatccagtttgggggaattgcgtttgtcattacattattggtgatcgtgttattgcaatatgatcggctaatgaataatgatttaggatatgatccggaaaatatagtgtatgcccccttgaataatatggatgatccggaaacggccaaacttaccgccgagttcaagaagttaccttatgtcacggctacggggctttcgtcaatggacattctaagtggttatggtggtttccctattctggataatgagaaaaactggctgttcacggcccgacaggtaaactataacgccgattatctctctctgatgaaaatccccttgcttgaggggcaaccactaaaaggtgacggggatatcttagtgaatgagtcattcgtgagtaagcgtgggtggacggatggtgcgatcggtaaatatatttatgatgatgagggtaatttaaagggaaaaatagtgggtgtcacctgcgatttcatggtgacttccttcttcactccccagttaccggtcatcatatttggtagtgaccggatgagttattgtaactttacggttcgtgtctccgagttaactccggaatatttgcgggaaatgaatgatcggattgcggaactattcccgaatgaggatgtcggttttacggtgctgaaaacgatcatagagtctcagtatgagggaacccgtcatttccgtgacggcgtctttgttgcctcgatcgctatcttgctgataaccttaatgggattattaggatatattacggacgagatgcaccgtaggagcaaggagatagcgattcgcaaggtgaatggagcgacggccccgaatattttacgtcttttatctaaggatgttttgatcacggcttttccggctatccttttaggagtgatagcctcacgagtcgtgggagagagctggttgaggcaattcgcggataagataccgctgactgtttttattttcatatctacggctctactggttctagcgatcatttggggatgcgtgatcctgaaatcttggaatatcgccaatgagaatccggtccgtagcattaagaacgaataatataacaggtaatataaattgcgtatgaagactattttgaggaatctcttgagtgtattacgccgtttcaagatggcgatgctattaaatgtattaggactttcgatagcttttgccgctttcatcttgattatgatgcaagtcgagtatgaccggaattttgaccgggggtatacagatacggaatcaatattccgggtggaaataatacagaacgatggcgatggacaagcgattgtttgccgtccattggcggatgctttcattcaatcctctccacatattgtcgcagggacattggtgaatccatggggtggcgcattatttttctctgtggaagagaacggtgagcggaatagtttcaaggaacaatacgtaagtgtttatccagattttacaaaggtgtttgattttgatttcttagaagggaatcaatcggccttggaagaaccgaccagtgttttgttaccgcaaagcatggcttataaattatttggaaaccaatcggctgtcggtaaacagttggtatttgagaatggcgataagctgacggttggaggcgtatataaagattttccccgtaattcgtccgtacaaaactgtatttaccagaagatggatccgagggaaaatatccaagaatggggaaactggaattatgaattttatgttcggttagacgatccaaagaacgctgaaggactgttcgagaattttgcggctcattttgatcctactcccgtgaaagaacattggggtgggtatcatcttcgtttgaacccattgcctgacgttcattatacaatgggtatccaatatgatacgactcctaaatccagtaagcaaactttgttggtgttgtttgcgatcgctatcgtgatcgtggtgatcgctggcatcaattttacaaactttagcacggcgcttactccaatgcgtatcaagagcattaatacgcagaaagtattgggtggcgaagagtctgtgattcgtctggctttgatattagaggccatgtttattagtgttttctcttattttatagggttactcttggtgtatatgacgggaaagacaagtatcgcatccttgattgatgcggatattacgttgtcggcacattgggggctagtatggttaaccgcccttatcgctatagcgactggtattttttctggtatctatccatcttattatatgacctctttccctccggctttggtattgaaaggaagtttcggtctatccccgaaaggtcgccaattacgtaacgtgctgatcggtatacaatttgtagcttcatttggtctgataatcggtgctactttcatgtatttgcagaattattatatgcaaaacacccctctcggttatgataaggatgaggtgattattacgaatatgaataacaatatccggaaaagtcgggatgccttcgccagccaagtgaaatctttctccggtatcgaagaggttacatatgcggagatgctcctctctagtcatgaccaatacatgggatggggacgtaaataccgggataaggatatacaattccaatgtctaccggttgaaccttcttttttgaaggtgatgaatgtgaaaatatcggaaggtcgtgatttccgggaggaagataaggcgaaacgttatggcacgtttgtctttaacgaacgtgcccggacggaatatgggctggagataggatctttaatagatagtatggagattgtcggttttatgccggatgttaaattcgcctctttccgcacggaggtaacgcctatggcctttttcgtatggggcacgaattggggaaaccaacctaatttcgcttatataaaggtaaaggccggctctgacttacggggagctatgctacatgtcaagactacgcttcaatcatttgatccggaatacccgtttaatgtccgtttcttcgatgaggtattgaacggactttatgagaaagagagaagcctcagttcattgattaccttatttagtttaatcgcgatctttatctcggtggtaggggtattcggtttggtcgtattcgatagtgagtaccggaagaaagagatcggtatccgtaaggtattaggctctactaccgaagagattatcgtgatgtttaacaagacatacatacgaatcttatgtgtttgttttgttttgggggcgcctatcgccggttatgtggtacatcgctggcttgagaatttcgcttataagactcctatgtattggtgggtgtatttgatcgcttttgctatcatagcggttatcacgatattgactgtcactttccagaactggcgtgcggcgaatgagaatccagtacatagtattaagaatgaatagaagatttttgtagaatcatattgctgctttcatagaaaagcatgtgtccaataattgtacaatggtgtccaattattggacacttctgttttatgaatcgagaattaatttattgagtattagtttaatatgtggtttggcacgttatttgaatattattagatggatttgagtataataaattaaaacaaatacagccatgattaagatcgaaggtttaagtaagtttttccgtacggaagaggttgagacaacacgggtacaaaaaaatcaatattccaatcatctccatatgaaaacgaattccccgcggtatgcaacaacaatcccgtttgtatagaaaacaaccgtgattgcggaaagtttatatacgccccggtttgaagtccccatccatctcctcctaatataccggtacgagcctctatatcagttgcctgcgatcggccaaaaaataaaagcaatatcaacagaacaaataacttcttcattacttacaaggtattaatattaatatttagattgaataaaagttcgacatatcatgatatagaactcccattcaatctaaatattgcttctatatcattattcggctccaagttagtgtattccgaatatagcgtcttttatgacgatcgaatcttccgaattctctatattatataaaataccttccatcttcccttcaatataaggggtaccacttccctcatgaaaacgaatactatccacttgtatccgaaatgaagatttcagtggatgatacactattttagcgtcatctttcgtgatcctaacagtagattctatctcttcattcaataatttacccttatcgatcagatattctccttctctcaatggaatcaatgagatcctcagcataggataaggatagtcagagatatgcactcctaatggtatctcccaatagaaaccgcttaaatcggtatttacctcctgccaaaaatttccatgatcaatgaaagaatgagagttcgactgattagctatagaaatatcttgactattcacctttccttcaaagtaccccaaatagtaaggagtttcttcaaaagaagtatcctcatccttgtcacaagaaacgaatgagaatagtaaaagaatgaataaagaaaagatgaaacctgccatcattccttttttagcttcatcccagtaaagcatagagatattccgtttttcagttgttgattccataatgactattattttcttataagacaggaaaccatcaaatacccctatcctcaaaatatataaaagattaaaataatgtgaatttatatccacacgggtacaaaaaaatcaatattccaatcatctccatatgaaaacgaattccctgcggtatgcagcaacaatcccgtttgtatagaaaacaaccgtgattgtggaaagtttatatacgcccccgtctgaagcccccatccatctcctcctagtattccggtacgagcttctatatcagcggcctgcgattgaccaaaagataaaagcaatattaacagaacaaacaactttttcatgatttacaaagtattacattacataacaaaaaacgattaaccctctctaatattatatagaacgagaaaagtctacccgtaagtagactctcctatataattagcttatatttatggttcaggaatagtaggtaaagtgaaaagaaaattatcaccttgatattgaaaccattgtccaaatggtttattatctttgctaaagataaagcttctttccaatattttatcaaataatatatcatcattagattcataaggtatagaaacatatgcagtaactttcttaaaattaataaatgaagtacatgttaatagccttgacaatgttttactggaaccaccatctctttctgttattaataaacaatttgtatcacttaattctccccagccaggttgaatacaataatttatttgaatattttgtcctacttctgcttttgttaaacttttatgaaaagtactaagtcctgtagtaggtgaagtattactcatcattggagaagaaatacttccccacgaaaactttaattctggaccaccagctaatcctccatcttgtgttgttaaacagtttatagttcctatatatacagaaggagtgataactacaggcccagatcttagtatatttaatgaatccatcgctatatcactatgataaaaaatcccatttttagaatattctccattttcaaaaaatggtaaatcctcatatgaagtactatttttattaataacccaaacagtatgatcctttataaaatcttcgtctactacaactgaatctaaaacacatataccgtcagatttatatacaacattatagccaatattttttgcttcattttcataacaaaatgtcacgattggtttactttttccatcccatttttttgagtaaggccaatatatttgaatatcattatcagataaataactaaataaattatctttatctatatctactacattcatattttttatttgatcaataagaatagatgtactttttctatagattttactagaatcacaatagatcatatctctaaatctatatgtctcatcttgaccataatataaagaatgttctactcctgattttacttcattcataactccttccgtaaaatccatagttgctattaaatgagctatctcggataaatcaaaagtttttttatccaaagatttggtagaaataacacctttttcttgaaattgtgaatcaagttcatcactactacaggacataattaatcctataacaccaataataaacaataaattaataaacttcatggcaataaattatttagttattaaaactcaccatataaatgattaaaattatctgctatttgcaacacacctttttcttgatcttttaaaggtattactaaagatggcatagtactcgtttgtaccatttcattatagatcacttctcccgtagaactagtaacgataacacgcacattacctacattttcatggaagttcactatcagttctccactagcttcttcaatagaagcgtccataggcaaatctacgagaatagatttttttgaatgcttccagttaccatctaagtgaacccgcctaccaaaacagggaatagcacttaacaaagccattactacaaataaaaatttaaataatttcatttctcatctcattttttgatttggatgcgaagaacaggctaatagctcgaataacaaagaaaaagggctaataagtgacggacaaactcaatttataatttactgataattaataaattataaattcatgaataggacaaacatttcatggatatatacatatatctatctaataaacaaaaagttacatcatattaataatataggtatacaaatctagctcctcccctataattcctagcttctgacgtacacgttggcgacgcttatttacagaatccggctgaatgtttaatagaatagcctcactgatcgtatctaaatgaaataaaactaaataacaatagcgtaaatccgcaagagtcatattgaactcagagaatttcttttctaaagatgggtagacctcatttgcttgagtaataatatttcgccaatatttttctgaaagaggggattttgtcgtaccaggaattactttttgggatagtttaatcactttccttgctatcatagatgataaaaacagattattacgctgttctgcgattctctggataatggatttttcttcttgtttcgttcgttcatatcgctcctctaacttcgctctagaataagatatattgagcaattcatcttcttttgataacttatcgaataaatcctgaagctcaagttgttttatattcaagctattctgcagtttcaataattcaatattcttttgctcaatatcgatttgctggacatatattctcttatttttcttattcatttgcaactgataaacgaataacaataatagacaaacagtaatagaagtaacaagaagtataaaagtccattgtttatccatctttaattgggtattttctaacgatatttttaaatgattatacgctttttctgtctttacgatattcgctttattttgtaatgctaagatagaatctgcggcttcattatattgctctaaataggttaaagcattttctatattaccttctgctttttccagttcataataattataaattatggagatatgcgtattttcatttagggttggtatgatgttcgcttgctctaaacataggcgagcattcttgaaatctccttcttctatatagacaccggctaaagcggaatagtctggagcattatccaattcagaaacatttattgatttccataagtattgcttagcgagttctatattgcctaacacactataaacatttcctatcccattggatatatatcctatatcagaagaatcccctagttccgctataatagtatcagcttctagcaaatatctcaacccgacctctgacgaatccgcaaaaacatacatacgtcccacatctcgcaaagcgaaagctgcgctccgcatatttccgacctttcgaaagtactgttccgcttttttatatttatcttttcctaataaatagtcaccgtcaaaatgatacaagtctcccatatagctacaaatatacccggcttgattatagtcatgacaacgtaaagcgatatccaacgcctgtaaataagccttcatagccagctcgttatccttatcctccacatacgaacgccccaagtacaaaccgatcctcgcttgctcctgccccgttccgtgcgactcgtaataggcttgcgcacgccgcaattgctgtacgtagggcagatccgtatataacgtgtccgccactttaccggatagcatacaccaacgagccaataatttatcactcaaattatcgggcacggctatgctatctaataggataagggaactatccggatcggatttcaacaaggattccgcacgatcaattagatatgtagcctcgctctcatctttacaacctataaaagagagcgtggataatagtaatatcagaataagcaaatgcctcatcggttcctatctttagattctatgcgcaagataggcatatttttcatcaaaccttaaagaataattgattattaggcttattgtataaaattcttatcgcttggatatctccatcatctttttggaaaaacacgtacgtgttttcataaattctcgtacgtgtttccgaaaaaagacgtacgtgtttttccgaaaacatgtacatgtttttatacatctgattttcaatatactaaaaacagtattcccgaaggcagggatattgtaggaaattccattatctttggactttcattggtaactttttaatctactatcaatatggcacaacaatccggaagattgctatccctcgacgtgatgaggggaattacgatcgcggggatgattttggtaaacaaccccgggtcatggaagtatgtatatacgcctttagagcatgcacgttggaacggcctcactcccaccgatttggtatttccgttctttatgttcatcatgggggtctccatgtttttctcacttcggaaatataacttcaagctgtcgaaagaaagcgtgacgaaagtattgagacgcacggtattgatattcctcgtgggattagggctgaatctgttcgggcatgtttgctacaatggatttaccgatttccagaatttacgtatctttggggtgatgcaaaggttggcgctggcatacggcttcgggtcgttgataggattagcgattaatcataagtatattttgcaggtagccgctggtatattgatattttactgggcattactaggtttcacgcatagtatggaaatgtcggagaatagcattatagcgatcgtggacagaactttattcggtacatcgcatatgtatcacgatgatatggcagatggtacacggatcgcctttgatccggaagggctcttgagctgcatcggtagtatagcgcatgtattactcggtttctacgtaggaaaggtaatacaggattgtaaaaagaacaatgagttgattatccgtaatatcttcattttcggtacgattattctttttgtcggtttcttactaagttacggctgcccgatcaataagaagatatggagtagcacgttcgtcttggtaacttgcggattcgcctccttattcctcgctttattaatctggatcatcgatataaacgggaagaagaaatggacgttattctttgagtcgttcggtatcaacccgttgtatctgtatgtacaaggggatatattggccgtattgctggggatgagcggtatctccgcctttatgtatatggatctgttcaggccggtattcggcgatttcggaggatcgctggcttgggctatcttcttcgtggtattaaactggataccgggatatttcttgtataagaagaagatttatataaagctataaaagcaatattcatatagtagcctcgtagtgatcgaggctactatataaatgagaaataccccatagagacgggtttcttagagccttcttatttcctcctcagcggctccttttcccttatacttatttttggtcgtattaaacttatagcgaacggtcagtcgtacctcacggctatcggttacattattcaccgtcagatccatgtgtttgttataaatcacgttgccatctttacgcccatgcgtaagatcaataccttgtagattaaaggaaagacggtcatcaaagaaagacttagtgagcgaggcatccatcataaacacgttcttgttgatataaatattttggaaatcacctttaccctgaaaaaacaaatctacatgtagtgtccatccataaggaaattgaattccattgttaaaccggccgataaacaacggtctatccatagaaagcatcctactattatgctcaatatccatccattgtttctgtaaacctatcgtgagttgaggatgccacttctttataataggagacgctatcaaaaacaccgatacgttatcaatccggtcataattacgatgcgtaatgatcgttatagcgggatttttctcatattgatccgtcatataaagaataacgtctttttctctctggtagctcaacataaattgaaaccaatcataactgcctgataaagtgatatcgtgtaggtttgtaggttttaacgccggattaccgttcatataggtaaaccgattgatatagttcatattacttgacaattgagcgtaagtagggcgtttcgttttcgtcgtataaccaagttgggtttgtagttttcctatttgcgtggataacgagacatttggaaaaaaattatcataggaacgttctgttgaaacatgttcataacgcaaacccatatttaggtaggcgatacggataaacttactatattcagcgaaagctcccgcacgatcttcccggatatggctatcggttgtaggaaggatttcctgtggattagtaaataagtctgtacggcgggtactggtaaactccgagcctaggctcaaattaccacctgctaatggataggaagcaatcaatttagcggcgtataacttattgtccacattattagtggaggtcacgatacgactttcttgctcttgactgttttctattacctcatttcctgtcctcgcttcgctccttagcatatccgcattgaaatccaaagaaagcttccctacggctcccgaataataaacgttgatttggtgagctggatgtttcacggtcgtactataactctcgctcaataaatagtcatagaaatcatcattggcatcaatccgactttctgtttgtccccctattttattttctggagaggcagacattatataacggacacccaaagaatggttatcgttaacttgataattcactcccagctctccccggtaatcattatccaatgaatgctgctccatccgattctcttgccgccaaagcgtatcgacatatacttgctgacttacattattgatgagcaaatagttgttatgcacatattgaaacatagcaaatacatccagattattatgacggtagtttaaattcaattgttccgtaaaatccgtgttttgcgactgtccccaagtagagcgagcctcaaagctcatcccttcaccttcacgctttatagtcttaatacggataaccgatttcacttccgccccataacgtgatcccggattagtaatcacctctatttgacgaatctcagaagagctaagacgatccagttcggagagatcccttacttcacgtccattgatatatataacaggaatacctttaccgaacacctgaaactccccctctttgccttgtatgccgggaatatacttcaatacgtcgttcgctgtcccggatttgcttagcaggctgttttctatgcgggttgtcaaggtaccgtctttgatctggaaatccggtcgtttccctatgacaacggcctcatccaacaagatcgcctcatccgacaaaacgatattttccatattaccggctcgtgtatctcggtagatggtttgataaccgatcgaagatactttgatcacataagttcgtatagatatagaatctcctgtttgaatgcgaaaactaccactctcatcactaaccgtaccttgaaggaaagaagaatccggaacagataacaatactatattagcaaattccacgggtaaaccctgacgatccgtaattgagccggtgataaattgcgccgatccattgacagccacaaataataacaacataacattaataagaatcttttttactactgacttttccatatcgctgattatttttgcaattgatttttcagcaaatataaagtgggtaaaaaagccagtcaaacaatagggatagatgtcaagatttggtgataaaacatggaaatctgtgccttatcacaagttttagggataaaatacaacctagttttccttattaagaaaactcttaaagtcttttagataggtacgtgagacaggaatctcttgttgtgtatcctccaaattcaaacggtagccttgcgcattaccgtttatgttcatgattttattcacgtttacgatataagcccggtgacaacggacaaaacaaccatatttctccatcatctcatccatttgcttgatcgtggaacggagaagtttatgcttcatattcccttcctctctataacagacatctacataattaccagaagattccatatacataatattatccggaagtacgcaaatcgattcttttgtatcgccggacaggattatggcatcaccccctttctcttcttgtatatttcgttcggataatagtttattcatccttttcgcttcttgcaaattgcgtttcaaagcattattctctataatgaaaaatccgaaaataaggggaataataacaatcgtgatcgccgctgacacatctataagcaacattttataaaaaatagtcgtatctaaatcactccaaaagtccattcgcatcaagaagtaatagtcataaatgaaacaagcgagtcccaaaaataacaaaaagcaggaacaatgtagtaagtttttaccaatagtccatcgttcaggatcataaaaacgtttgaataatttaggaaacaagacaaaagcgacaacagagaatataaatgtcaagcctacgaaacaccataatacccaaaactgtatcacgctatttagccgatagtgaaaaggctcgaaaatagcgagtattaacgccactaccatcgagtttaacagaacgatcacccatggtctatctatagcgtacataggtttattaagatattccttcaaattcatattcaattctcacatgtagttaaagataaaattttcacaaaggtatgcatttggatataaaaaatcccctagatcaaaatcttttgacctagaggattaatctatctattactctacgttataaccggagataaccaccttcggggtctcgcctctcgtatctacatctttccaatggatgttgatctctttcttctcgcccgggagcaatgagaaatagttatcgctatagaaaacggggaggaattgctcgccatccttctcgcccactacattcacacggatcatcagagccggtgtggatgaagtgttctccaagatagcggtggcggtccaagtaccgtcattacccttattggttgccacgttggatcgtaaagtaacctttggcatctcacgcaaagcttggtagttgccttcctctacgccacgcagatagaagttatccgatacgatcttgccattctctgtcaacgtcaacttgacgaaatgagcgctggatacgctagctgggaaatccagtttcatacatttgttggtcgtatcttccttactatccacggaaacctcgttttcccatgaaatagaaccgtccatattgatgatttgagcctttgccgtcaaaccattacgtacgccggcgctatagttcactacctcgatctcgtccgtaaccggattccattgaatgtgcagaggctcggaggccttcttgcaaccaaagtaagcggcggtaggctcgaaataataatcgtaagtctgccataccatagaaggccatgccggatgcgtcatccacagcaataatcccttacggttcaagcttctcgattcgaacataccccggtaaccatcatagtttacccactgagccagatcggcgaattccttggcgttgttcggcttaccgaagcccttttcgatgatagcgttgaaagaagcgcaagactgggcgccttccatcgtataatcatgttgcccccattgagcgttttgcggccaaagcgcttccggagagaaagtacgaaccaagctctcgtaattcatcacgttgggcataccccgctcactatggaacttatcactaccattcttcaagctaaagtattctttaacaggaagcgcacggtacgggccatggccacttaccacctcatccgccgagctggagatataatgtaagcccggatgatcctctttcacgatacggcgtaaagccttgtcgatctgctccggcgggaagccctcgttgcgcccgcaataaataccgatagaggcatggttacggaaacgtttcacataatcctctgcgttggcgataaacatctccggatcataaggatcgggtccgtcggaaggattcgccaaccagaaatcttgccagatcatgataccatgacgatcgcaagcctcatacaattccttgtcgccgatttgtcctacccagttacgcatcatcgtaaagttcatatcggcatggtaagccacggcgatgtcgtactcacgaccccggtaattcaggttagactcaccgaatccccagttaccgccacggccgataaaacgacgcccgttgataaagagactcaagatgctattattctcgttgaaggtcatttgtcggatacctaccttgaaatcctcagagtcggataccttatcgcctaccttaaaggtgaaattagcgtcgtataaataaggagatccgtatcctttaggccaccacagacgtgggttctgaaccttcaattggctgaagctatttggatcgaaagtaaccgtcttctcctcgtttgcggccaattctaccggttgctcgaaagtgatatcgccgatctttcctgtcaatacaccctttactggagcggcatcatggttcttcacgatcacttccggagtcaaggtagcggaagtcgtatccggcaacggtaatacaacctgtacgaacgggtcttgaatcgttaccttgcctgtagaagtcaagtacacatcatcccaaatacctatattacgaccacggatcgtcgagatccaatcccaaccgatcgaagcgtggaaggttgggttatcagcgcctaagataccaccgttgaaatccgtattcttctcacatttctccttgatagcgccgatatgctcattcttgatgatctccaccgcgacaacgttcttacccggtacgaccctgtctgtaacgtcaaatacacctcggataaacgctccctcgatacggccgatcttgttaccgtttaaatatacattcgctttccagttgataccatcgaaattcaagaacaaacgatcttgcttgaatccttcgggtacctcaaactcatccctataccagaaattagagttgaagaatgactcggatatctgcatcaagttatccgcgtaattcggattcgggatagctccgatattcttataactgctcaataccgttcccggtacggtcgccacgatccaattttccggagagaaagaaggtttcgatatttcctcaccagaagcggttacctcggaagctcgttgtactttccagtttccgcccgataaacggatctcgtcttttgtagaagccggagcagcagccggttgggcaagcaagccacctttacccatcacctctatctcgcttaagatatagcgtccgtcattagccggttgctccatccatacccgtacgtagcggccttttccttttagcttgatctcatccagattagcatctccacccggaagattcgctatgtcaacccattgtttagcgtcgtcggaaacttgaatcttacccttgatcgctttattgatccaatgtaattttactttgtcgaattcggattggctacccaagtccacatagacccactcctctcctgtcgtggcactcatccaagcgctattaaagaatttggaaggaagcaaatctatcaacttatcttggttatagaaattcatctcgaagaatgcccaataagcggcaccttccattttcaatcgcatccgataataagcatattcacccggttgatcgaatgtcaaagtctcattcaacatacgggtgggcaacgtacccggatcccagctattcttgttcgggtctgaatgggccttatacttgctggccttacccggcatacctttaccctttaaggtagccaattccgtccaagtatttccatcattcgatccctcgcaaacaatctcatatccatccttaatcttattctcgtcataagccacgctgccacgaaattgtaccttgtcggctttctctttccagttattcagcgtgaacaggaaataggcatcctcgcctgtaaccgcattacgagaataaggaccttgatcgatcatccactcacgctcacgacgagctatatccccattttgcgtggagagatcgagatactgaggttgtttatcgctaataacaccatccgtcaccagttgagccgttagattgtaatcataactggaggagttgtaagcgctacgcaaaagagctatgttacgatacgtggaataatccggacgtaatgaaggagaaaaatcctcccccggatctcccggatacgaaccgatacctctggtataataatccgaccgatcgaaagattccgccggaacaccgctctgcccacatcctcctagcaatgctgagaccgctaccgctccataaagcgtcaagagtcgaggcaattttttctttttactgaatgttctcatactacttattgtgtttctctaaattagttagtttaataagataccgtcacgtcaaaaccctccttccgggcccgttccgcaatcgcatctaattcttctttagtagcttttttcaaagctttaaccggggtctccctatctatcgtataaatcatgacttgtttcggacggatttgttttaaggcggagatccagcccgctatctcctcttctgtcatattattaaccgatttcccattcacttcccccttcaagaacatggtctgtataatcaagtttccgttaaaacgacataattgttttaataaagactcgaaattaaacgccggagaattaggtacgtctatctgccgaatccgactgtctaatacagaatccagtttcaatatgttatcctctattttattcaaggcttgaaagacctcctctttctggagcatcgtagaattagaaagcacggcgattttagcatcagggaaaaatcgatcccggatagcgaccgtatcatcaatgattccaccgaattccgggtgtatcgtaggctctccgtttccggcgaatgtaattacatccggagcgatcccttccgctttcatggaatttagtttttgctccaaggcttccctcacttccgtacgagtaggcagtttactatgggtcctatgattctcattcaatccacattcgcaataaatgcaattaaaagagcataatttcccgtctgtaggaagtaaattcatccctaaagagacacctaggcgccgactatgtatcgggccaaatacaattttatcaaaaagaattgtagacatagcgctgtttgtttttacccacgcaaatctactctaaaatttccagcgaagcaaagcataaagatctgttttatcagaaccgcttatctcctccgtatcagtacctatcaaatccctgtcccaataatgagtgtgagccagtttcgcggataaggataaacgtttccaaatatccagacgaaaggtaagggcaaaccgcatcccatccccataaaaagagggcatattaaaggcatacaatatattcttctcatacgaactgacccggctattgtaatcatccgtatgaaaccacgctagataaccatccatttgaagaggtagggtagtgggcttccagcctatactttgggagatcataattcctttattaagtttctttataggatcatcgaatagaataccatctaaggaagtcttaaaaataaaaggagaagaaaagttataaacctgttgaaaacgaatacgatgttgtttataaggattgattctcaataaattatcattttcaaaagttctattcttttctttttgtcgatatttataacgaagataagttgaaaagtttctactaagggtatagtctatctgagccatatattcctgtcctccggaaggagcgtctatcccgtatttcaaccaaggaaaacggaataagtccgcataaacggataatttccagcgggcgatcggggttaattgcaatcccatataaaccccttgctcattctgaaccgtagagccttgcgagaaagcattcccaaacaaagcttgataacggcgatcgtaatagcggtataataccaagaaagatatataagaagcgggtgttaactgcaaggcattcaaggtagaaatagctccgtttttcgaaagagcggtctcgccataaaacttgatacggttacttttcaacatatagtcaacaccgatgttgaaattgttggaacctctgaaatagaacaaattataaggttttggatcggggtccatcttaaacttaccgaatgaataggagagagccgttaaacctacatgaaaatgagatgtagcatagcggatatttcctccatatacctgcatcgttatcattttcctcttttcccaatcccgttgtaaacgatgaagtccatccgtttttaaagaggtgaacgtcaagctgtctacgcccgcatccattttccggtacgaatagaaaacacttatatccaagtttttaatcgtgatcgtactagctacccctcggaagaaatcctgttcattggttgagaagtgcctacggaagccatttgtccttcgctccgcttgagcgactactgccgtacgactaggagaaaagtcattgctaatcaccagaccttgtccgaaagacatcttgtaatcccctatagccaagctttttaaccagttgatatcttttaggaatagatgtgcggaataaaagtcatatcctttatgatatgcgttccaaaaaggttcgcccgcatctttctcagctacgaagcctgcttgtaaacgatcctcgaaagtataggaataacgtaaggagtgatagaaaggttctcctctatatttacgattcggatataacgaaagtatgctgtccgtttgttcaccatatccctttttctgttgaaaacattgatcatacctgatttgtaattcattacgaccatatttcaacaggttcttaaccgtaagcaaccgtttttcaacaagattatcacctatataaacaaatggaaggagaagagatatcgtctgaaaatcgatatcctctatattcttcaactcatagatgctaaccatatttccgtatcgtttccggtaggaaagtagctgctcgatttggctatcggatagaaaaggtaatcgcttcagttgttcttccgtcacggcattcaaatcaaaaggatgctcagttaaataagataaatcggcatacaaactttcgatacgctccgtatcctcggtttccaaggctagttcctctacatactccatccacttatcaacagaatattctatttgagaattagcgtaataactatttatcaacaggattatcgacaagattataaacaatcgtttcatagctaagtatcatttaaaaagagaatgataaaccaagaccagtactcatccctaaaatcggatggtaaatagaggctacatctatcgtaaagcaagaaaagttataaccaattcctaaagagggcaggagaggagcggtctgtattccggcacgaataaaaaaagaatcgaaagcggtgtattcaagaccaaagtttccaacaactaggttttcattttccgttcctacacttcctgtaattaacagactgtttataatctcccattgaaaacttatttgaattaaataataattaaaatcttctatttcaatatctttatctcctatagaaacagaaggaaaattcattattaacattcctattaacaacttatcaataggagagaaagtgattccaagatctgttgacagtctggatcttgtattttccaatagatcagtttgcaagaaactatagtgaactccaagccctaacgcccattgatcccccaagcgttttcctcccagcacacgaaccatcatctccctgtacttatcaaacccgaaaacagagatatcaacacctgcggataatagttgattcggataataaaaactaccggacatcgtacccagttctttcaacatgtgccgattaaagtattctaaatgaatggattttttatctttatcgacaataagggccggattgaataaaatagattgcgtcgccacattccctcccattcccacgctacgaacatccggtaaacgtaagttatcaacaccatgtacatacaatgaaaatacccccgcaaacagggatagcaatagatatttcatagttaagattttgtatggtttctacttattcttcaagtttttcttattatccttatttatcctacgctgtacctttttaatatcctcattaggagaaagttgttcaggcttaatccccctttgcaataacatatcacgtacagcagtattgttatcaatatgttctttttcaataggagattgtccatatagatccttcgcttgcacatttacgtttgtcatttcagtcgctaggtctttagcttttatacttatagtcggtaaaaaatcagcgataggtctattcgtggggacgttcattctctttttcaacatctgtgtacttaaattgaataaagcttgatctcccttagaacgaataatcgcgaatcctttattatcaatacctctttcgtataagattccggataattgtttttcagtctgacttaatttttctctggcctttaagcgttcacaatccaataggcgttgttcaatcacctcggccttacgggtttgtaccgcaaaataagtctgagcgaaagctacttgtggtttacgactatcaccattttgtgcgattaagtagcatgcgtagcgtgttaataagatgtcatttatttgttgctcagcaccatgccccacaataatcactttcccgacatcgggaaagtgatcctctatattttctcccgcattccggcacgcttctttggctttcaccactacattattgataaagttatcccatttggcatatcctaatagaggttgtaactctctggcactccagcattctatgccttctacctcacatgaaatggattcgaattttccgaatagggcggtaatttcttctttcttcatagttaatatattcttaagttgttgtcaattgcgcaaatgtaatgttttatattcatttagcaagttattaacagataaatgatgctgagagtcacgcagtatttatattttcgcggtatatgatacgaaaagggatatattgtattttggctctactcgctctctgtagctttaaagggatggcgcaggcggtaaagacaaatattgttccggaaggttatcagaaagctcaactgtatgaaggtgatacaatggctgtcgtcaaccttcgggaagttttcatatatcctcaagttaagtttaagaataagcgtgaacaagcgaagtacaataagttagtacgagacgtaaagcgtactttgccctatgccaagatggtgtatgatacgttgatagagacctacgaatacatggaaaccttaccgaatgacaaggcccgccaagcccacttgaaacggatggagaaagagttgttcgcccaatataaaccggaactaaaaaaattatccttctcgcaaggtaagctacttatcaaactgatcgatagggaatgtaatcaatccagttacaatttattgaaagcctatctaggaagtttccgtgcgggcttttggaatttcttcgccggaatgttcggagccagtctgaaatcggaatacgacccgaaaggtaaagatgccatgaccgaacgggtcgtcgtattggttgagaatggtttaatctgatagttgcttgaagaaatcccagatcacgataccggtagtaaccgatacgttcaaggaatgctttgtaccgtattgaggtatttcaatacatatatcacagttatcaaccacattttgttgaacgccttttacctcgttacccatgacgatagcgtatttctttgttttgtctaactgcaagttatctaacatgacactaccttccgcttgctctacggcacataccgtatacccctcttggcgcagtttatcaacagcctccggggtatccttgaaatattcccaatctacggtttcttccgctcctaaagcggtcttatggatctccgcgttcggagggcaagccgtaataccacaaagataaatagcctctacccggaaagcatcggaggtacgaaacacagaacccacgttgtttagacttctaatatggtctaagacaacgattaaaggaatcttcttactttccttaaaagcctcgggagtcaggcggttcaattcggttacttttaattttcgcataacaaatatctttgaccgcaaaagtagcgaatatccgtggatatgccgttgaaaagctattaataagtagtggacataaaatgaaaaatatttcttgctttattcaaatacttgtccatacacccccctttctcaaattagcaaatgaataagccacttatttattacgcgctatcaacagcccttatacacctattgacagccttgctggaggatctattttttcacaatcaaggttatcaacaataaacagctaaatattcataaagtctataactataagaattacaatctatagatagacatccatgctgttggtatccttttgataaaccgttcacagactttaataagtcaataaccaaagattgtaacaaaaatgtattaaccatttcaacagcctatcatattcatcatatttatttttaaaattaaagattaataagaatataatataatgattgtggataactcttgatggttcacgacagctcatccatcgacagcaaagataagaatctttcttgttatttctataaatgaagaaagtttatacctttgtgctttgtgaacaataggttgataaactagataagatgaagattatcagtaatactttctgtggataatattgtttatatatagtgaaaagcctattgggagcagtagaaacaggaatcattaatatataaggctatgttgacaaaccaatcaatcgggtacatggatgcgcccgttcctaaggatttagaccttaaggaagcgatcgacaagttacgtaaagagaagaatgcgattattttggcgcattactatcaaacaggcgatatacaagatatagcggactatgtgggagacagtctggccttggcacaatgggcggctaagacgaaggcggatatcatcgtgctttgtggggttcactttatgggagagacggcgaagatcctctgtccggataagaaagtgctggtaccggacttgaatgccggttgctccttggcggatagttgtccggctacggagttcgccgagttcgtcaagcaacatcccggtcatacggtaatctcttacgtgaatacgaccgccgccgtgaaagcggtcacggatgtggtggttacttccacgaacgcccgccagatcgtggagagcttcccggaaggtacaccgatgattttcggtccggatcgtaacttaggtaattatatcaatagcatcacgggacgtaatatgttgctttgggatggcgcttgccacgtgcatgagcaattctcattggagaagatcttatctttgaagaaacagtacccgaatgcggaagtgatcacccatccggaatgcaagcagccggttatacaggtctcagacttcgtaggatcgaccgcggctttgctgaagcataccattaagtccgacgcgaaacaattcattgtagcgacggaaagtggcgttattcacgagatgcgcaagcagagtccggataaggaattcatcccggctcctccgaacgacagtacttgcgcttgcaacgaatgtaatttcatgcgcttgaacacgatggagaagctatataattgcttgaagttcgagatgccggagatattcgtggacgaggaggtacagaagaaggccatcaaaccgatcaagaagatgttggagatctctgagaagctgggactctgatccaaacaaatgcgggataggtctcaaccgataggccggacttgagtgatataaaagctaagcccggtctattatatgtaaataatcaaaattatgtacaatatctacaactatccttataatcatttgaatttaaaatatttatcctattgttgtagataggaaaacatctacaatagtaagtctttatctaccatcatttcccgcttttagtaagtgtctttgccatgccatcaaaggaattttctacactctacgtatataatcagtccgtttttcttcctttctttatatagataaaatattaatatataagtatttgtggtttttgtcttatgctgatataggtagacacattcaataacaataaaatgtgtaattattgtcacgccgatggtactgcgtaacagtggaagagtaggtagccgccgtcttgaagaaggcgatagccgatggagaggagtcagtccgtaaggggtgactcctttttttatattaaatttgatgtattaaatctattatctaatatcatgaagaaaatctatttatttctatttagtctgtttatctgtaatatccttgcggcgcaagatcaagactataaaatagtcagagatatctcttatacccaatcgaaaaatccatatgcggtggaacgttgtaaattggatctttattatcccgagaacgcaaaagacttccctacggtagtctggtttcacggaggcggcttgtcgggaggtagcaaattcatcccggaggaattgaagaactgcggattagccgttatcgccgtaaattaccgtctgctacccaaagccacgttgagcgattgtatcgatgatgccgccgccgctgtcgcttggacattcagcgaaattgagaagtatggtggggataggcgtaaaatctttgtctcaggtcattccgccggaggttatttaacaaatatggtcggactggataagaagtggttgactaagtaccggatagatgctgattccatcgccgcattaatccctttcagcggtcatgcgatcagccatttcgcttatcggcaggcgaaggggatgaaagatacccaaccgagtatcgacgagttcgcccctttgttttacgtacgtcctgacgctcctccattgattatcgtctcgggcgaccgggagatggagatgctgggccgctatgaggagaacgcctatttttggcgtatgatgaaagtggccggacataagaatacttatatctatgagttggacggatatgatcatggatcgatggccgctcctgccttccacatcttaaagaatcacgtgaaggcgatcttgaaaggttcagaaacccggtaattcgataaactatttaatttaatacgtatggttctcttttctttattaatggtcttgatttgcttgaacgcatgttctggagcgaagacctcggacaatgtaacggtgtatgtcacgacaaacgatcgtgcgaaagatttcgtgagaagtgagatcgccttgggggacaaacaagccgcctcgccttccgtgataacgatagacccttcggtgcgctatcagacgatggatggctttggcgccgccgtgacaggctctacctgctataacttgatgcggatggctcccgaggatcggacagctttcctgaaagagactttctctgatacggaggggatggggtatagctatatccgtatctcgatcggctgctcggacttttctttaagtgagtatacttgttgtgacacgaagggtgtcgagaatttcgccttgcagagcgaggagaaggagtatgtgataccgatcttgaaggagatcttggcgatcagcccttctataaaaatcttgggatcgccttggacttgtccaagatggatgaaggtggataacttaaaggatttgcgcccgttcgagtcgtggactagcggacagctgaatcccgcctattatcaagattacgctacctatttcgtgaaatggatacaggcgatggaggccgaggggattcctatcgaggcgataactccccaaaacgaacctttgaaccgaggaaattccgcttccttatttatgggatgggaggagcaactctctttcgtgcgtgacgctctaggccctaaactgaaagagactggcctcaagacgaagatctacgctttcgaccataattacaattacgataatatgttggagcagcaaggctatccgatgaaaatctacgaggatgagaatgccgcttctttcctgacaggtgccgcttaccataattacgggggcgaccgggaggagttgaataacgtaaacggcaagttccccgataaagaattaatatttacggaaacttctatcggcatgtggaatgatggacgtaacttagagaaacgcttgatggaagatatggaggagacggccttgggtacggtgaataactggtgtaaggcagttatcgtatggaacttgatgctggacaacgagcggggaccgaaccgagagggtggttgccagacttgttatggtgcggtggatatcgatcgctcggattataagacgattacccggaattctcattattatattatcggtcatttatcctctgtggtgaaaccgggggcagtacggatcggctctaaagggtatacggctgatgggattatgtattccgccttcgagaatttagatggaacggaagcgctcgtattactaaataatacggacgggactaaaaatataacggtaaacagtggcgaacgttcgtttacctatgaggttcccgctaaagcagtcgcttctttccgttggaatctttactaataaggagggggtgttaaaagttggtattatggcacgcagatttagcagatttacgcagataatatattgattttcatgtcataaatctgcggtcatctgctcaatcagcgttatctgcgtgccatgttcacacttttgacacacccccgaatgtccaatactttatctatagtggcaacaagccggtagcttatcatatacggctttatccgccttatccatatccgtgtcatggcctactttagcgatcgccttgctgatcgcttttggggaggtcttttggggatcgtactggagatggatcatctgggtatctttgtcccaatgagcggataacacaccatttactcctttggccgctttctcgatacgttccttgcacatatcgcaagagcctttgacaccgaacatggcatgctcggaggctacccccgtggcgctttgcgcatgcatcatatgcccctcatgcccaatcataggcttggcgggctcgtcgccgttattcatcatggaagtttttccctccagctgtgcgctggcgtctatggcgaagactccgttggttacgatttcctcaccttctcgcaagccattcaagataacataagagttaccaagggaagggcctagctccacctcacgcatcaagaaagcgggggtattcgtatccggttgctttacgtacacgatagcacgtttacccgtccagagcacagcggtttgcggtacgacgatctcgttcttatagttgcggagcggggcgcttacgtttgccgtggcgtacatctcgggcttgagctccaaagaggcgttcggtacctctacacggaccttggcggtacgggtcgtcgtgttcaagatcgggtcgatgaaagagatcttacccgagaacttcttgccgggtagcgcttgcaaggtaaattccaccggatcacctttgctaaggaaagggagatccacctcgaaagcgtcgaacaaggcccataccttcgtgaggttcgccacgtcgaaaaggatagctccttgggatacataatcaccttggcttacccgcttggacaggacgataccgctcgtgttcgacttgatctctacaaccggggagatagagccggacttctcgatagcggcgatctgggcatctgtcatcttccataaatatagtttttcacgggcggcctgtatcaattgagattgtcccatgcggatcgcttccaacaattcttgctgggcggtgaaaagctctggggagtagagggtagcgagggtctgtccggcacgcaccgtctcacccgtgaaatcaacgttcaagctctcgatgcgtccgcttacatgggctgtttgagattgcaggctacgctcgtccggtacgatcttgccgtataaacggacttgcttgaccggattctggcgggataccttggaggtttgtacgtccgctaaggctgctgcttcttccgaaagctgaatggcgttgggatcgatggccttgtcggagaaggagctcttacgtacaggggtcaaatccatggcgcagatagggcatttacccggcttgtcttggcgaatttggggatgcatggaacaagtccactcgccggcctcgttctgttggaggtcgtggccatgcgtagggtcgtgaacttccgtgccggtctcgctcgcttgtgacgtatggctgtcggtatcggagttatggaacagaagccagcccaacaagaggccgcccgttaggaacaggatatatatcaggtacttggattttacggtttcatttatatttttcattttcttattcgtttacagaggtggatattaatttctcgattccggcgatttgggtattatattccgctatcgcttcgcttttcttcaagtgatagtccaacatttgtcgctccacttggatcacgtcggtcaaggtcgtacttcctgtcgagaattcccggacgatcagttggtaggtggccaacgatagatcgtattgtttctggtacaaatcgattttccgtgcggcatcttccaattgctgggtaatacggatatactcggcttgcagttggttcatcgtgttctcgtacttcaactcgctggatttccaataatgcttgctttcccgttgctgtgcgttatatttcttacggaagataggaaggctgatctttagcatgggcatgaacatatcctttccgttcataccggacatagagcccatagacatatcttccggtttcttcccgatcaaggaatactggaggccgatacctagcatggggtaactcattttcttgtccatctccgccttggcccggtaagcgtttccttccgcctccagcatggtaagcatggggttgttggagatgacgctgtcaagagccatcgactcactccatgagagaggaagccgttccaacgagtcggggacggaaatcggggtagctagcgactgattgagcaacgtattaaaagcagcctcggccgttttccgttgcgataacaaggaggctagcgtattctccagttctaccttctccatctggattcgcagtacgtccgacattccgcccatagagttgccacttcccatagagcctccacccatagggctaccgccggacattccggacatcgtactaccggatgctcccgtgctttgtaccgtagggcttcccatgctactgcctcccatacccgacatacctccaccggatacggcgggaggagtcgatggagcagaagatacgggggagggtaggacggaggaaccgcccgccttcgccgacggagcggagaagcggttcaatgccaactgttccaactggtctagcagacgaaggttcgcctgcgtatttttatattgctcgctgatattgcaaagctggtaccattgactcttcacctcgtaatacaggttgttgcgactgttacggaattgttcgtaagccatccgggccatctcggtcgcctcgttgcgggccgccttccgggtaccgaaccaagggaacatttgcatcaaggtgaaatccgctatttgctttccggacaagatctccatcggtttcaggaagaaaccgatctccagttccgggtccggataggctccggcttgcgggactttctccaaagatgccttatacagggagaagtcggcgttgatctgcggattgttacgtgccgccagttccagataatagcctaaactatcggccggctgggagtaagcgaaaaggacgtttagcatccccagtacacctgccatgatgattgatctgattcttttatatctcataagtcgttacctcctcttgaattttattcttttgttctttctttatagcgttctcccgccaccagcattgcaggacgggaacgacaaacatggtcatactctggatcagcattcctccgaacgtagggatagccatcggtaccatgatatccgcccccttaccggtagaggtaagtacggggagtaaagcgatcagggtagtggctgtagtcatggccgctgggcgtacccgtttcagtccggcggctactaccgcttcccggatatcgtgcttggtgcgggggtctcgctcgaggaatacatgatggatgtaggttcccatcaataccccatcatccgtagccacaccgaacaaggcgatgaaaccgacccagactgccacgctcagattgatcgtgtgcatctggaaaagatcccgcatattctctccggcgatggagaagttcatgaaccaatcctgtccgtaaagccatagcaagataaaacctccggcgaaggccacgaacaccccggagaaatggatcagtgaggcagtgaccgtcttgaattgaaagtatagaaccagcaggacgatcaacaaggcgaggggaacgacgatcatcagccggctggtggcacgctcctgctgctcgtaattgccggcgaacttataggatacgccgggatcaaggttcaaccctccctcctttatttgttgctcaaggatgcgggaagcctctttcacgacatccacttccgccttccccgccagtttgtcgaagatgacgtagcctaccaagaaagtgttctcgctttggatcatctgcgctccacgggtatagttgatatcggcaagctctttaagcgggacttgcgccccagtggcggtcggtacgaggatcatacctagcgcctctggattatctcgaagctcacgagcgtagcgtaggcgcaccgggaaacgttccctgccttccacggtgcgggtcagtaccatgccaccgacagcggcacttaatatctcttgcaagtcctccacgtttacgccgtaacgggccatattctcacggttcagttcgatctccagataaggggcgcctaccgcacggtcgtaaaatacggaagaggggataacggagggtacctctttcaatgccttctcgatcgcctttccggctttctcgatcgtctccagatccgggccatacaccttgatacccatcggggcacgcataccggtggataacatgacgagacgggcctcgataggctgcagcttcggggcggaagtcaatcccggaagatgggtgacgttcacgatctgttgccagatatcgttcgtgttcttgatctccggtcgccattggcggaagtaatcgcctttagcgtctgggatcaggctgtctgagggaatcagccggaaaccgtctttggggttatatacgcctccatcttttaggagatactccccttgccggtttaccttgaaacgttcccttttcccgtcctcattcaggatatattccggacggtagttgatcgtattctcgaacatctgtaccggcgctggatcgagggcggagtttacacggccccatttaccgatggcggtctccacctcggggatagaggccagccgtttgtcgagcgcctctatataatcaaggttttgctcgataccggaatgcggcatgctagtcggcatcagtaggaaagaaccttcgttcaggctaggcataaactcctgtccgatgcctctccatatccagaaaccgaatacgatggtagctcccggaatcaacatgaatttccagcggttatccaagcaccagcgcaatatcctctcataatacataacgagcagccacaggatgcttaggatgatggctacgcaacccgccacgaacaatatattggggagcatccctttttgcggccccatcggcaaccattcctcggataggtaatagatcgtgacaaagagggtgataccgatattgatataagtgctcatttgaggcttcttccaataaccggacaatagattattcaccccgactgccgttagcccgatagccggaatacttccataaataataagtaaggcgattccggccacgatcaacaggcaattcagtattttccgtatcagccttgaatggatctttatcgagaacaaccaatacgatagggaaggaagcaagatcaatcccagcacgaaggcggaagccaaagcatacgtcttggtataggccaaaggcgagaacatcttcccttcctgcgcctccatggtgaagacggggaggaagctgacgatcgtcgtgatcatcgctgtgctgattgccccggacacctcgcttaccgccttataaataaggttgacaaacgcctttcccccctgtatatgcctgttctcgggcatctcccggtaacggatgatactttccacgaagacgacccctacatccaccatcacgccaatggcgatcgctatacccgataaagccacgatattagccgctacccccgtataacgcatgatgatgaacgtggcgagcaccgctatcggtagcatgctggcgataacgatagaggccctcagattgagtaccagcacgatgatgacgatcacgcagatcaatatctcgtgggaaagggcggtctccaacgtcccgatcgtctccttgataagccccgtacggtcgtagaacggcacgacggttaccttggagaccgtcccgtccgccagtaccttttggggcaatcccggctccatctccttgatcttcgcctttacgttattgataacctccaaggggttggagccatagcgggctactaccactccgcccacggcctccacaccctccttgtccagccctccccgtcgggttccgggaccgatattcacgaacgccacgtccgatatgcgaaccggtacgccttcccgaacggtgatgacggcattctctatatcttttacattcttgatataccccaagccccggatcaggtactccaccttgttgatctccatcgtctcggcgccgatatcgaggttgttcttcttgatggcgctcatgatatccatcacggagacgttgaaggcatacatggcatccgggttcaactcgatctggtactccttcacgaagccgcccgccgaggcaacctcggataccccctcggcggaggataaggtgtacttgacgtagaaatcctgtatcgtacgcaactcctcggcgttccagcctccggtaggtttaccggtcttggggtcccgtccttccagcgtataccaatagatctgcccgagggcggtagcgtccggtcccaaggtaggctgtacgccttccggcaaggttcccagaggcagggagttcagcttctccaatatacgggaacggctccagtagaactctatatcgtcatcgaagataatgtatatgaaggacatcccgaacatggaggaactacggatcgtcttcactcccgggatacctaaaagagaggtggtcagcggataggtgatctggtcttgtatatccttcggcgagcggcccatccattccgtggccacaatctgctggttatcgccgatatcggggatggcgtctaccggaatcggattccggggaatgatccctccgtgccaattgaagggggacgtggaaatgccccatacgataatcagcactagtaaaagtaaggttaccaccctgttctcaaggaagtaacgaatgattctatttaacatttgaatgagcttttatgatttgaaaacatatgagaacgcttatttgttcgtctttgaaggcaagcgatcacatgagtactcgtgatgttttacgccagtactcgcaatggattactccagtatttgcaatggattactccagtacttgcggtggattactccagtactcgcaatagattacgccggtactcgtgcgtaaacagacgtaaatcgccttttaaaaaggaagcctataccgctaaatcaaaaaagtacaatgatggacgaataacgggatagcgctattctccttgggtggattaataaagggattggaacgtgttgtctcgtctcgcccggcgatcttataggagtcgagtagatcgaacaacaaaactacagcgacaggagcggacaattgcacgagcgtattcgccacatcctgatcgacggataacttaacatattccgtctcggtagagcagcacttatgggacgtgcccgcctcaccgcaactgggacaagtgtcaagatacagcaagctcacctccgccaacttacccatacaataatggtaattcagcgcaaacccagaggaaaccccgaggtaaagaacagcgagtatgaacaataaaaatcttctcatcccaaataatatattccgcaaatatatgaatattttttgaacgggcaatagggtggaaaaagtgctcgtagggttgttaaaatcagaaccttttctttatagccttgttcaaggtaggtaattaatctaaacaaaacacatttatgagactatttgtacaaggagcagtattactgctaggtatgggattcttatcggctcccgctaaggctcaaaaggtggtcatcgaggatgatgcgccaaattcgatagtccttgtcagccaagacaaggcaggtgatgaaatcgtgaggataatgaatgagacgcagagccctcgtttccacgacccgaaagccccccgcttcgtattgaccgatcgtaagggacgtttcgccttgggtatcggcggttacgtgaaggctacggcggagtatgatttcggcgggatctcggatgatgtcgatttttatccgtccatgatcccgaatggtgggcagaactacgtccgtaaccagttccagatggacgctactaccagtacgatattcttgaaattagtgggtcgtaccaaacacctcggggatttcgtcgtgtatacggcgggtaacttccggggaggcagcaaggtcttcgagctccagaacgcctatgtgtctttccttggtttcacgatgggttacgattatagtaccttcatggatctggccgctcttccgccctcgatcgattatgcggggcctgccggacaggttttcagccgtgccaccctgttacgctatgagcgtgctttcggtaagggatggaaagcgggtgtaggtatcgagatgccagtggtggatggcatcacgaaccaaagcgtgaatatcagtaaccaacgtatgccgaacttccctgcctatatccaatacgcttggaataagagcagccatatccgtgtagctggtatcgtacgtaatatgacgtacgagaacttggtggcgcaacgggccgagtctaaggccggctggggcgtgtttgccgcctctacgttcaatgtgacgagcaagctgaacttctacggtcaggctacttacggccggggtatcagccagttcttgaatgatatcagtaatctggacgtggatctggttccggaccccgaggccaaaggcaagatgcaagtgcttccgatgatgggttggtatgctggcttgcagtataatatcacgccgaaggtatttgtctccagtacctatagccagactcgtttatacagcgagaatgattacccggttactccgtcggatcaataccgctacggtcaatacttggtagccaacattttctggaacgtgaacgccaatctgcaagtcggcgccgagtacttgagaggttggcgtaccgatttcaacgatatgacccgccacgccaatcgacttaatgtttccgctcaatataacttctgataatgtagcgttttgtaaatgtgccacaccgggggattcttggtgtggcatttcttttcgaggcgattggcagatcagcgattaatagatgttcgccatgctaaccagcggctcatacagcttctcgatatcctgcgaatcgatctcgatctctacctgatcgccggggataagggtctgtccagcaggagccaagtccttgcgatcccggtgaatagtcttgatgatacaacgttgggggagggtgaggtgatctacctccttcccgtcgaaataggcacctgtcatgatctcgacgaacaggctggaacgcccttcggtacggaaggctggagtcgagatcatctcgtcatagagaaccacgttaaagggctttatctgtagcatttccgtgaagtaatacgtaagcccgccgacaatgatagaggggtagaatacatccagatgcccggttatctccgtaatcaagacgatacccgtcagtggtgtccggactaccgccaccaagaaacctaccatgctgattaacatgatatagctgatgctctccgtctcaatgaaaccatacttcaccaataataaggcgatgatctgcccgaacaatcccccggtaactagtgtagggatgaaattccctcccggcagtccggaggagaaagagagagacgtgaatatcaagtggatgagcatcatcgccgctatccataaaatggggtgatatccatgcatcgcttgcatgataaggaattgctcgcctcctcctgtcaagtcgatctccgtcaatgagatcgtatacgctatgataagcaggtacaacatcttcatataaggaggatgcttcagtctggtaaagaaatccttgcaccaaagggtaaacatcgagtaaattttcccgaagacggaaataaccacggccagaaataagaacaacttcagttgatctataaaagtagcctgcggggcaatagcgctaatctgcgagtaggggttgaagggaaaaatcaagctcgctacgcctcccgccacgacccctgccagcaaggtggtaatggcggtcttgggagcgtcgaaccgttcgatggactcgatcaccaaaagtgaggaagcgaggggagcggcgaaagcggcggccaatccggcacctgcgccggcggccaaaagttgcttgcgctctccagccaatacgtgtccccatttggaaatgatattccccacgtaagatccgatctgtacgcacggcccctcacgaccaagggacaggccggcgctgattgctaatatccctcccgtgaacttggcgattaattgtgtcaacgggttcttataagtgatcctgccattgataaccgcccgtgtctggggaatgcccccaccggtaatcagcggcatcttcttgaccatccaattcacacaaagcaatataccccatagcgtgaagaagaacaagacatggaaataccaagggtaatgaccgtcgaaaaaaagtttccggctattgaataactgctggagcagatagtgataaggtaccgctaccaacccggtcagcaatcccacgaaaatgcttacaaaataaagcctggcgtcaataagtttcaatttccagatccgccagcgcctcaattttgttatatctaagagatcattatccatcggactcaccttgttttcgtttcctgttacaacaaccaaggtaaataagaggtttaaaatctcattccattgaacctttttttaaaagccttgttattaagatatagtgtttttcatggtattagaattaagttagattaggttatccgtcttgttcgtgagaatagggcggttttcctgtttataggggtttgtactttgaggcggttaggatttcttgggcgtcgttgttttgcatcaacgcctccggggtagatcccgtctcctttatgtactggttgatgatctgccagcctatccaagtcccgatattcccgggagcgtcgttcccggggaaaatggtcggggtatcctcgaaatattgggaagtcgtcagttgatccggggtataaagatgcttgcgctcgatgattgctttccagattgttccttcgttgtccttgcaccagttgtaggcctgttcggtgtatcccattagctcggcggcatcgggaacgcctaaggcttgcgagagcaggtatttgatttttccctcgtaaatcatccggtccagcaatacgttctcttttcccgcgaaaggatattcggacatgagccaacccgccagataatccgggactacaagtccacgttgcattttcaatttctgggagtcatagaagaaatcctgatacaagggatagtcctttcccatatacttatcgatggaaagggaaagcaggctatcgcctaccaatacgttctggttgaaaccagatacatgcatatagatagcggggatctgcatcgaggggaaattctcctttagataggcgaatccgtaccccaaggatttctcgatatcctccacggaatcatattgggtgatagcgtcacgatacaagcctttcaaggtaggctccgagtaataattccgcattttctcgaagaagccgggagtctcgatggtttgcaggtttaatatgcctttcccgatgatatccagcatttccgggtattgtttgattagttcgggttgcaaggtggtatctcccgtatcgatcagccggaataaatccttgtcaaaacgattgatatgcaggggttcgacggtagcgtagttgatcgtatttgtgttttgcccgttgcagctcaatagcgtagcggacaaaatgcaggccatgatgagttttgtaaccatatctcttcgtataataatgtaatatgataagaaacggatcgcatggggtaatattgtgtgactggcatcttattactacctttacctcccttttatttaagattcatcatgcgatatacgaacaaacaaattttaaagatcacgtatccggtattaatcagcttgctcatggagcatatgatcggattgacggacaccgcttatctgggacgtgtcggcgaggttgagctaggtgcctccgccttggcaggagtctattatctcgtgatttatatgctgggctttggtttcagtgtaggcgctcaggtgctgatggcacgtcgtaatggtgagggggagtataagcggatcggcgaggttttcacgcaaggcgggctattcctttttctgctggcggcggtgttgtttacggcctctaatctgcttacaccctatctgctccaccggatgatcggctcagaagaggtgtatcgagcgacgatgagctatctggactggcgggtgtacgggttcttcttctcttttatagcggtgatgttccgtgcgttttacgtgagtacgacgaatacgaagatcttgacggccaattcggtggtgatggtgcttaccaacgtggtcttgaactatatcttgatattcggtaagttcggtttccccgtcttggggatagcgggtgccgctatcgcttcctcgatctcggaagctgtctccgtaatgttcttcgtgatttatacgtggaagaaggtagactataagaaatacggtctgtttcgttttacgagagtggatttcaggatgctgggacaaatattgagcgtctctatctgggtgatgatccagcacgggatcgcttttgggggatggtttatcttcttcatcgctatggagcatctgggcgagcggccgttggcgattacgaatgtggtacgtagcatctcctcgttcctgtttatgttcgtgaatgctttcgcctccacgaacagctcgctggtaagtaacttgatcggcgccggggagtcggaccgggtgcttccgctttgccggaggatgatcgggctatgctatgcgttcgtgctaccgatcggtatcttgatcgctatgttcccgtctaccgtattgcgtatttatacggataacccggatctgatcgctagctcgatcccctcgctgtgggtgatgctgtcctcttatcttttcgccgttcccggttttatttatttctttagcgtatcggggacaggcaatacccgccgtgcgctggaaatcgatatggctagcatattcgtgtacgtattatatatattgtatgtcgccgtatggttgcgtgcggacgtggcggtttgctggactacggagtatgtatataatatcatgatcctttcttctttcttctatctatggaaaggaaattggcgtaacaagaaaatctgaagacttatcttttgattagtacggtaattcgtaaggataaatcaaaaaagaccatcttggcattcacgttctgtgtgatatggcgttccgctttcgccaattcttccatcaaatcgatcacgtttcgctcgttgacgaaaggggagaacttaacggagaagctagcctcgtccagattcatataattaagttccggcgattggaaccggtacatgaagttctcccggatcaaatgctgacaataggagaggaagtttttctgtcgttcccgtccgatccctgccatgacgtccgccatcgctttcatgccttttacgtttcgtgcccatgagtttcgcatcatggccttgaattgctccagaaagaatttattttcctcgcccaagctaatcgcctccatcgccttgatgaaacttccggaggagaggtgagcgacgtgtttagcgtcatcggatgaaagtccgaaacgggataccatggcattcatgatcgcatcggtctcaatgggacggatgtggatgcgttgcgcacgggattggatggtcccgaggataaggtccggtgtctcggataccataaggataaccgttttcataggaggctcctctataattttcagaagcttgttggcgcaagtaggatgtagtttctccggcaaccaaaccatcaggatacgatattccgcctcataaatctttaggctcagtttatggataatctcatcgctttccttggaatagatgatcgcttgtgagtttccggcctcgatataatccagccattcatccatattgaaatagggatgttctttgaggaacccacgccattcactgagataatcatcgcagacctctttctttttctctttcttggctacgatcgggaatacgaaatgcaaatcgggatgtgccaattcgtcatatttaaggcatgacgggcaacgtccgcaagcgtccgtctccgtccggttcgtacaattcagataacgggcgtaagccaaagccagcggaaacgccccggcccccccttgctccgtgaataactgcgcatggggtacgatccctgtccgagccgattgcctcaaccgttcctttacttcctcttgcccgatgatatctttaaaatacatgagatatttccttttctatagaataaggaacgaagttacggaaaagtattcagatatcaaaaggcgcggggttttgtaaatatcaattgacatatatagagtaaaactaaaaacggatacaataacaagtcaagtccaataaagaatatgtatttcattaccttagaattttaaaaataaccatacttagtacatgattgttcaatcgtgtacttctattagacaactcagcgtggaaaaacccctattgtatctcaataaatttcttttgctattttgtaaacgctatccgaggccatcattgtgtagaaatgtaagctcggtacgccatgagcgatcagatccttgcactgctgtatacaccattccacacccacctctttcgcttccgcatcatctttacatttacgtaattctgtcgcgaaaggctctgggatatccgcacggaatatcttcggaagaaccgttaattggttcttgaaaacgatcggtttgataccggggatgatgggaaccgtgataccttccgcacggcaacgatccacgaacgcataatatttttcattatcgaaaaacatctgggttaccagatattcagcgccatttttcactttctcctttaagtaatggatatcagattccatattgggcgcttcctcgtgcttctccggatagcaagccatgccgtacgagaagggagtctctataccgtctatcttggaaccgtctagtgcgataccttcgttgaaatgatttacctgctgttgcaagtcagtcgcgtggtcgtgatataactccgggttttgctgggaggcctctaaggtctttatatctccccttaatattaagaggttgtttacgccaaggaagttcaaatcgatcaaagcgtattccgtctcgtctttcgtaaagcctttacatataatatggggtacggcaggaataccgtatttattctggatagccgaagcgatcgctacggagcccggacgtttacggatgtttactttctggaaacttccgtctggtaaggttttatagacgaactcgctatggtgggaggtgatatttatgtatttagggtcgaattccttcaacttgtcaattacattatacaccttctggatactgttacctttcagcggcggtaatatctcgaaagaaaaagcggtactcttactatcccttatcagatcaatgactttcatattttaattatttttgacgcgaatgtagcaaaaatcttggtaacatagattttaatccgctatttgtatatatccaggccacggctctttcatttacccatccgtttcggcaggccggaatgcatgaatctcaagtgaaattccgcacaataagtttacgagagaaaattgtgtataagaatctgataatcagtaattaaaaaacaggataatctttctgcgaaaacacgtacatgtttttggaaaaagtcgtacgtgttttccggaaaggtcgtacgtgttttccggaatccttccaccgaaaacaaaagcgcatgttaaaatttacaagaaaccccactttaacgaaatgttaaatgaaaaagccgtggccttccgtttgctttttttagtttataggccgaactatatataaattagcgtatatttgcggtacacaaaatctcccatagcgacggctatgggcgtttttgcttttgagcgatattattaacagtgtaatttgttaattttaaactaattacagcaaattgtatagatatggaaaatttaaattggtctgagctgggatttggttatatcaagacagactacaatgtaagatgctactatcgtgacggcaaatggggtgagttggaagtttcttcatccgagattatcaatattcacatggccgctacttgcttgcattacggacaagagtctttcgagggtttgaaggccttccgtggaaaagacggtaagatccgtgtattccgtatggatgagaacgctaaacgtatgcaatcttccagccggggtatcaagatggctgagttgcctgtagagatgttcgaggaagctgtacgtaaggtcgtgaaattgaacgagcgttttgttcctccttatgagagcggtgccgctttatatattcgtccgttgatgatcggcttgggcgctcaggtgggtgtgaagccggctcccgaatatatgtttatgatatttgtcactccggtaggtccgtatttcaagggtggattccagccctcgaaggtgtgcgtgcttcgtgagtacgaccgtgcggctcctaacgggacaggtacgatcaaggtgggtggtaactatgccgctagcttggtagctggcgagatcgctcattccaagggatacgccgccgtattgtatctggatccgaaagaaaagaaatatctggatgagtgcggtccggctaacttcttcggaatccgtggcaatagctatatcactccgcaatcccactcgatcttgccctcgatcacgaacaagagcttgcagcaattggccgaggatatgggcttgacggtagagcgtcgtccggttcctttcgaggagatcgctacgttcgacgaggctgccgagtgtggtaccgccgcggttatcgccccgatctcacaaatcgacgatttggatgagaacaaatcttttgttatcgccaaagacggcaaaccgggtcctgtttgcgagaaactatatcataagctacgtgccatccagtatggcgacgagccggatacttacggatggatctcgatcattgaataatatcttttgtttcgtaaggactggagtgcgctccgtctttacgagacagaatacgttgataggcaattgttagtttgaactttactttttgcaataaaattgcaatctccgcattgcaaatgagaaaagatgtttatctttgcatcggtaattccaaattttcaattaccaattatgtaggtggaagcattctttaaaacacataaatatctggtagagcatctgtattctccggtacgaaggggattgatggatgagatcaattgggaggatcggttgatcggtgttaaaggttcgcgaggagtcggaaagaccactttcttgttagactatgcccgtgaatattttggtgccgataataaggaatgcttatacattaatttaaatcatttctattttacggagcgtacactcgttgatttcgccgccgagtttcgggctaaaggcggaaaggtgttgttgatagaccaagtatttaagtattccaactggtcgagagagttgcggtattgctatgataatttcgaggacttgaagatcgttttctccggctcgtcggtgatgcgtctgaaagaggagaatccggacctgtccggcaaggtggtatcgtataacctcagggggttctcgttccgtgagttcttgaacttgatgtcggggaaccagtttcctgcgtacacgttcgatgaggtattagagaatcatcaggaaatcgccaaacgtatttgctcggtcgtaaggccgatggcttatttccaagattatctacatcatggtttttatccgttcttcttggaaaagcgcaacttctccgagaacctgctgaagaccatgaacatgatgctagaggtggacgtgttatacataaaacaaatcgaacaaagctacctgccaaagctacgcaaactactctacttattggctacgagcgctccttgtaccccaaacgtgagtcagttgagcaaggatatcgagacatcccgggccaccgtgatgaactatatcaagtatttgacagatgcccgtttgatgaatatgctgtatccggtgggcgaatcctttccgaagaaaccctccaaggtatatatgtataactcgaacctgatgtaccccatccgtccgatggaggtaaatgccggggcggtgcgtgagtcgttcttttataaccaactattgaaagacaataagctgaatgaaggaatcaagaacgcccactttctggtgaatacgatgtataatttccggatcgaggaaaacatgaaagtgaagaacaatccggatatgtactatgctgtcgataagaccgagatcggggaggggaacatgatcccgctttggttgttcggttttctatattaagtaagaatcttttttaatactaatagttttataggtctatgacaaaacagaagaaatttttaacctgtgatggtaatcaggccgctgctcatatctcgtatatgttcagcgaggtagccgcgatttaccccatcactccgtcgtctacaatggctgaatatgtagatgaatgggctgcagccggacgtaagaatattttcggcgagactgtaatggtacaggaaatgcaatcagagggtggtgccgcaggtgctgttcacggttcattgcaagctggtgccttgacaacaacctacactgcttctcaaggtttgttgcttatgatccctaatatgtacaagatcgccggtgaattgcttccttgcgttttccacgtatccgctcgtacattggcttctcatgcgttgtgtatcttcggtgaccatcaagacgtgatgtctgcccgtcagacaggtttcgccatgttggccgagggttccgtacaggaggttatggacttggccggtgtcgctcacttggctacgatcaagtctcgtgtaccgttcgtgaacttcttcgacggtttccgtacctctcacgagatccagaagatcgaggctttggagaatgaggacttggctccgcttatcgaccagaaggccttggctgagttccgtgcccgtgccttgaacccggagagaccggtcgctcgcggtatggccgagaacccggatcatttcttccaacacagagaatcttccaacacgtactacgaggcagttcccgctatcgtagaagaatatatgaacgaggtttccaagatcacaggccgtaaatacggtttgttcgattattacggagctgaggacgctgagcgtgtgatcatcgccatgggttctgttacggaggccgctcgtgaggctatcgatcacttgatcgctaagggcgagaaggtaggtttggtatccgttcacttgtatcgtccgttctccgctaagcatttcttggctgccgtgcctaagaccgctaagcgtatcgccgtattggatcgcacgaaagagccgggtgctaacggtgagccgttgtatctggacgtaaaagactgcttctatggtcaggaggatgctccggtgatcgtaggtggccgttatggtctgggttctaaggatacgactccggctcagatcctgtccgtattcgagaacttggcgttgccgatgccgaagaaccagttcacgatcggtatcgtggatgacgttactttcacttctctgcctcagaaggaagagatcgccttgggcggtgagggtatgttcgaggctaagttctacggtttgggtgccgacggtacggtaggcgctaacaagaactcggtgaagattatcggtgataacacggataaatactgtcaggcttatttctcttacgactctaagaaatccggtggtttcacttgttctcacctgcgtttcggtgatcatccgatccgttctacttatttggtgaataccccgaacttcgtggcttgccacgttcaggcttatttgcgcatgtacgacgtgactcgtggtttgcgtgagaacggtaccttcttgttgaataccgtttggggcgccgaggagttggctaagcacttgcctaataaggtaaaacgttacttcgctcagaagaatatcactgtatattatatcaacgctacacagatcgccttggagatcggtttgggtaaccgtaccaatacgatcctccagtccgctttcttccgtatcacgggtgttatccctgtagacttggctatcgagcagatgaagaaattcatcgttaagtcttacggtaagaagggagaggacgtagttaacaagaactatgcggctgtagaccgtggtggcgagtacaaccaattgacggttgatcccgcttgggctaaccttccggatgatgaggctgtcgtaaacaacgatcccgctttcatcaacgaggtagttcgtccgatcaacgctcaggatggcgacttattgaaggtttccgcattcaagggcatcgaggatggtacttgggcgcaaggaaccgctaaatacgagaaacgtggcgtggccgctttcgttccggtttggaatgaggcgaactgtatccagtgtaaccaatgcgcttatgtttgtcctcacgcttctatccgtccgttcgtattgaacgatgaggagcagaagggcgccagcttcgctatgttggacgtgaaggctccggccgctatgaaaggtatgaagttccgtatgcaggtagacgttctcgactgcctgggttgcggtaactgcgccgatatctgtccgggattcaagggcaacaaggcattgtctatggttccgctggaaggccagttggctgaggccgataactggaactactgcgtagctaacgtttcttctaagcaaaacttggtagacgtgaagtctaacgtgaagaactcacagttcgctactccgttgtttgaattctcaggcgcttgctccggttgtggcgagactccgtacgtgaagttgatcacccagttgttcggcgaccgcgagatggtggctaacgctaccggatgttcttctatctactccggttctgttccttccactccttatacaacgaacgagaagggtcaaggtcctgcttgggcaaactctttgttcgaggacttctgcgagttcggcttgggtatggaattggcgaacgagaagatgcgtaaacgtttggaaggcttgttgcaacagatcaccgtgggtgagcatgctccggctgaggccaaggaaatagccgccgcttggatcgctaaccagaacgacgccgagaagacgaaggaattggctccgcaaatcatggcattcgttgagcaaggcatcaaggagggttgtccggtttgcgctcagatcaaggaattgtctcacttcttggtaaaacgttctcaatggattatcggtggtgacggtgcttcttacgatatcggttacggtggtttggatcacgtgatcgcttccggcaagaacgtaaatatcatggtattggataccgaggtttactctaacacgggtggtcagtcctcgaaggctactccggtgggcgctatcgctaagttcgccgcttccggtaagagggtacgtaagaaagaccttggcttgatggctactacttatggttacgtatatgtggctcagatcgctatgggcgccgaccaagcccagacattgaaggcgatccgcgaggccgaggcttacgacggtccttccttgatcatcgcttacgctccttgtatcaaccacggtttgaagaagggtatgggtaagtcgcaagctgaggagaaagaagccgtagcatgcggttactggcacttgtggcgttacaacccggctttggaggcagagggcaagaatccgttcaccttggatagcaaggagccggattggagcaagttccaagacttcttgaagggtgaggttcgtttcgcttccgtagctaaacaatatccggctgaggccgctgagttgtttgccgccgccgaggagaacgctaaatggcgtctgcgtagctacaaacgtatggctgccgagaattgggatgtagaggcttaatataacaggtcttttattatagaatgagggcggtgtctccggaaacggaaggcaccgctttttttatggggtggatgggggaagctgcacataaggcaatacggacctgtactaccgtatgtgcaggcctgtacttccttatgtgtcagcccgcgctaccgtatctacaagtccgtactaacgtatctacacgtttgcacgaacgtatctgcaaatttacacaagcgtatctgcgagtttgcacgaacgtatctacaagtctgtactaccatatctgcaagcctgcgctaccgtatgtgcggtttctcagaagaccgggatcgaatagaccagccccagcgatatacggtgtgtatccggctctatggctcccattcgcgtggcggctttctctaggataacgccccggtaggtgtataggacgaatacgaaaaggtcgagttgcttgaaggggaagaattccacgctactctgcgcattccacgaacggcggtacatccctttccggaaatcaccgttgctcttatacacccgggcggtctcgtacgcccctttcacgtaaacgttccattgggggtggacacggtaatccacgtcgccgataatcgataggtattcggtgttcatggcggtatgaggcgtgccgggcagacggctgacgaccccatgttggtcgatcccttggcgggtgtacataacgtcgaggtacgttagcaacgggcctttctcataggtattgccacaggtgaaatagtaggagtagcgcttgcgggtctgctgtccgacggcggtggcataacgcagttgcaaggtcttgtccagataatagctattccagttgaccgtgtacataaagggtatcttggccttggcggtaccctcgggaagtccggtagggtagatgtcctcatcgttaccgttgcggttattcacgatctggaaacaaagctcgtggtccgggttgacttgccagttgcccgagataccggcttggtaggcggtcagtaaattattgaactcgctaaactctcgtacccggatggaattgacgtaatactcgtatcccccgaaattaacgaactgcttgccgatcgtgaaattgagattatgccgtgcctttaggttcacgtaagccagctcgagcgaggaggagaggttgtcgagcgaatagggatcggagtatttgttgaacgactgccggtaatgataccccagccacttgcctacatcccccttgatctccagccggacacggttcagcttgaagttcataccgtctagctcctttccgacaaactcagcgttggccgaggtgaaaagctggaagttcatctcggcgctattgatcttgatctctccgttcgataatcgttccacgagtgtaggttccccgttattctcccgaagggtctcttgggccgtcaggctggcgttcgtggctagacaaagcaagaaaagtagaaaatgtttcttcatacgatagatttagttggtaacagactacaaaagtataaaaaacgtcttaaccaagatacgtttaaggggatgaaaatgggggggtaggggatgcggactttcgtgctatccgcatcccgaggtgtatacgctttcgccagcgtccgtctagaatctcaattgagaattcaattccgggaactgcgcttgatgccaatacgggtagatcggggtcgtctggcttgccatatcgaggcgcttcacctgctccgggttgaggttccagcctacggcctctaggttctgccttagctgctcttccgtgcgggctcctatgataaggctgcttacggtaggccgttgcaataaccagttcaaggcgcattgggctacgctatgcccggtctcctcggctacctgttccaatacctccacgatgtcgtacaggcgttcgtaagaagtagcctcgtcgggtatcgggcttcctccgcgagcgacacgcccgtccgtcgggatcgggttattccggcggtacttcccgcccagacgtccggcggataaagggctccagataatggcgcccaccttctggtcgatgcctagcggcataagttcccactcaaaatcccggttcaacaaggagtaataaacctgttgggccacgtaccggctccatccataccgctccgatacggaaagcgacttcattaagtgccagccggagaagttcgagcaagcgatataacggaccttcccgctcgtcaccaagtcgtccaaggctcggagtgtctcctctaccggggtattcgcatcgaaaccgtgcatatggtaaatgtcgatatgatccgtgttcaatcgtctcaggctcgcctcgcacgcctgtatcagatggaaacgggaagaaccgatggcgttacggctctccgggctgaggttgaaagtcgccttcgtggagatcaagaggcgattcctcaatccgtggatcgcctttcccaagatttcctcggaaagaccgttggagtagacatccgccgtatcgaatagattcaccccggcgtccaagcaaagattgaccatacgggtagcctcttccaccttggtatgtccccaaccttcaaaaccattcgtgccaccaaaagtagccgtacctaaacaaagtgccggaacgtataatccggaacctcctagttgtctgtattccataaaaaactatatctattatttgatgaaggaaatgaaaatacaaatgtaacaaataaagtgtatctttgtcattaaaagaagataataggtataagtatgattaaggcagtattttttgacattgacggtacgttggtaagtttcaagacgcataaactaccggactccacggtccgggccttggacctgttgcgagaaaagggaatcaaggttttcatcgctaccggccgccagttgcaatctatcaataacctcgggacgcaagagttcgatggctatgttaccttgaacggaggatattgcttggccggaaaagataaggttatctataaacataatatcccgtcgggggatatagaggcgttgatccgctatcaagagaatgaggaggcgttcccgtgcgccttggtggaggaagatgggatttaccagaactacgtggatgattctgtgcgacagctttacgacatgctagacttccctcatcctcccttgcgtcctttgcgtggcaacgggggtaaggaagtataccagctgatagcctttttctctcccggccatgaagaacgtatcatgtccgtcttgccgcattgcgaggctactcgctggaacccgctatttgcggatgtcgtgccgcgggggagcagtaaggcggtagggatcgataagatcatcgagtattacgggatctcgctccacgagacgatggcttttggcgatggaggcaacgatatggccatgcttcgccacgccgggatcggggtagccatgggtaacgccggcgacgaggtgaaagaggcggcggattacgtgaccgactccgtagatgacgatggtgtcatgaacgctttaagacatttcgatgttatataaataaacagtttaataacgctaaatcacaaacgctatgattgatgaattggtaagctataatcgtgagttcgtaaagaacaaggggtatgagaagtatatcacgaataaatatcccgataagaagatcgccatcgtgtcttgcatggatacccggctgaccgagttgctacccgcctccttgggcatcaagaatggagacgtgaaaattataaagaacgcgggggcgatcatatcccaccccttcggaagcgttatccggagcttgatggtggcgatttacgagcttggggttgtagaggtaatgataatcgggcataccgattgcggagccaagcacatgaatagctccgagatgatcgaaaagatgaaagagcggggaattccgcaggaacgaatagatatgatccgatattgcggtataaacttcgagtcgtggttgcggggattcgagacctccgaggcttccgtgcacgagaccgtggagcaaattcggaatcatccgctggttccgtcggatataacggtaagagggtttgtaatagactctgttacaggtgaattaacgccggtggagtaatccccggcgtatttagacttatttgcacaattcataaataatcgaaaaaatgaaatattttattatgttctacaacattgtttcggataaaatggttatctttgtaacgaattaagaaagaaagatcgttttaggattatttattaacggctttccaagcgtgggaagcgtaaaacaaaaagattatgatgatgagagaaaatgagaaaagccttcgtgctttagcgatgttgcgttatcaagcagatcgttaccagtcagctggcaatggtgccatgagtcagcgattaaacgctgagatccgtcgccttatgagcgaaatgagtgtagatgcggataagaactaaaagaccgcgtcttttttaagtaaagaattaaagtaagaaataaattagatgtcatctcttacctccgttcaaaacggaatggtgagagataggaaatgaggattacctttggcgatacggccgggtgagccttttttttgtgccctttcctttcctcctccttcgcgtatcagggaaattacttatatttgtggatgaaaaagctaaaacaataatcatttgaacacaaaaacaatgaaaaaagcaggattactcttaatgtcgctggcattaagtacggctctttgggcggaaagtccggagaagaaaggtttggacgtgataaatagatcgaccgccgaggcgcatatcggtttcttggccgatgatgatctggagggccgtgaggccggtttccgtggaggccgtatagcgggcgattatatcgtggcgaacctgaaatcattgggtatcgaccctgtaggagactcttattaccatccgtttgaggcttaccatatggaacgccagaagagaggggcccgctggcaggtgcagccggattccatagcggctatcaagcaaaccggtgttttccagaaactttccttgaataatatcttgggtaagatagagggcaagaacccgaacgagatcgtgattgtcggcgctcactatgaccatctgggtatcgacccgatgctggatggcgaccagatctataacggggcggacgataacgcctccggagtctctgccgttttgcagatagcgagggctttccttgccacgggccagcaaccggagcgaaccgttatattcgctttctgggacggtgaggagaaagggcttctcggatcgaaagccttcgttcagtcttttccagagataaagaacgtgaaaggatatttgaatttcgatatgatcggccgtaacaataacgaggcgaagcctacccatgtggtttatttctatacagaggcgcaccctgctttcggcgattggctgaagaacgatatcaagaaatacaacttgaatctggcaccggattatcgtccgtgggataacccggtaggagggagtgataacggttccttcgctaagataggtatccctattatctggtatcataccgacgggcatccggattaccatcaaccgagcgaccatgccgaccggattaattgggacaaggtggtgaatatcacgaaggcctcgttccttaatatgtggtatatggcgaatgagaaagatttttagagattatacgtctttttcaatagaagatatctaataaaagtaagttaacttcatcggcgaagtaagttaacttactttggcattttaattaacttactttgccgatgaagctggcttgcttttatattctgaaaaaacgcttgaattactgtaatttcatatcttaccgcagatacttagttctacatgaacttacaatggaagatattatcacctagcaccaagcaaacgctgtcatcaccgatgaattctgctccaatggtaaatgcctgtgccaatccatccggagagggctgttctgcatactcgaaacgcaccccataatcagagccatccccaagcagacgcttgaatcccggcaaattgtagggcgttgatatgatcaagatatcccggatgctcgccagcattaacacactgataggataatacaccatcggcttatcaaaaatagggagcaactgcttgctcactcccttagtgattgggtagaatcgggtacccgagccaccggctaaaacaattcctttcataattatgaattttcaattattagtatttaactcagaatacctcacaaataaagatccggtaaaacaggacaaatacatttacaaagaaaaatcattccagcactttccctaaaagtccaattcctttattttccataaatcccccaacatcaaatcagcttcaataggggaaatctcctcaaatccactaccattagtaaatgtcatttcaccaaaataaattttcccatcaacattatatagatctactcgaacatgagaaaagcctcgagataatttttttactatttcaatcattatatcgaaatttctcggcttatctactacacctttaaaattaccatatgatcgttgattccacgcttgaatattccatttcaaatcataaacatttctagtatgatttgtaaatctatccatatcaacccaacaatagtaaggcactccatcaaaacataaaaacttatagtcaaccaaatcagagcctctagaatctataaattcttctgcgataattttaggcgaaatatccttataatgcatttcacagtatctacaactataatccgtctctaaagagaatttcaatttccttttcaactctatttttttagcaagtgttatcgcttttttattgcgaataatcaccgcatctccagaaccatgattagttttaagaacaaattgattaggtaatatatcgagatttacatcgtcatatttatcccataccgctagtaatgggactaaatactcacttccaactttatctgcgacccaatctctcactttatacttatctgaacacaatgtttttcgaggatctttatcgaataatttcgcccactgcattttttcagtataagtttttaggttttcccaatccagttctttaccttgcctatttttataaagacacgcatcataagctttaagttcctcatcagacattctcgaaacagccaaagacatttttctgtttcttaaaaaatctttataatatttaatataagcaatcgattggtatatcaaaggcaatttagcttgaataaaatgtttcataatatatataataagcgactaatatcttactacaaattttctcaacaaaaccatcaaccgtgttctactttttaacataagtaaaaacacaccaacagcataaataaacatacctaccacaagttgaagtattaatgtaataatatttatattcattacatttcctatttgaaaaacaaaaacaaacattactatcccaattagtataggcggaatcgtatttaacaaatattttttaatgaaaattttttttctaacaaaatacgactgatatatacaaacaataatttcagcaaaaatagttcctataacagctcctcttgcagccatatatggtatcaaaattatattcataatcaaattaacaacagcacctaaaaacaaggaaacaacaaatattttatcctctttataaggtattaaatattgagttcttatcacattggcaaaagccataaacgggactgtcacagccaatcccattataagaattccacattcttcaaattcataaccaaaaaagatgggggctaacacaaatgaaatacctgccaatccaaaagagatagctattgctaataacataacagcttccatcgacatgtcaattaacttaaaaacctctcctttatccttactcgtcaccatatttgcaattcgaggcataagaactacaccaaatgccattatcaaactcattggcacattaattattttttcagcattttcataaaatccgacttgaacattcgaagaaatggatcctagcataattttatccatatacttataaagactcaatgccaatatcggcaaaaacaatataaataggggtcgaatatgttgtttcatattagcccaagaaggcctcctccatgagacatattgctttaaagcaaaccaaactactgactgcccgacaaaaacagaaagggctaatattagcgcataaatccaaagatcagtttgtgtcttaacaaaaacgaaaactaaaaccacagacaaaattttcacaagagtatttcttcctactgttaatttaaacttctctattccaaagaaaaaccaattaatatcaaagatagcagcaaaaacataaataccctgaataagaaatatattctgattatcctctaccccaaaagacaaaagcactaaataaataaatgttataattattgaaaaaacgatatgaaccgatagaatttcagaaaatattctattcaaatcctccttgttatttcgaaccatagcaatcgtccgacttccataatttttaatccctagatttgcaaacaaaacaaaatagttagcaactgcatatgtataagagaaaagccctatattctctgctcctaaaactcttgacacataagggatcgtaaatagaggaataaatattattaatatctcatacaaaaattgatatattatattaacctttagagacatttgattttcttttcttatcacttaataaaaccgctaatatataaatgactggcatatgaaacttttcagtaaaataaaatggttctgatataaacatcaacaagtatgcacctacaaatcccaacaataaatatatatcaccatttttgtttttaagttttactaatatataaataaatatacttaagaatgaagccaaaccaactaaacctctttgaaaagataaatctaaatagtaattatgggctcctgcactaataccaactaaggatctcacatagtccgaatcacgcaaaccatatcctagaataggattactttgtattgcatacaacatttgttgccacaataaagctctacctgaaaaagtaatatcttttccaaaaagatcagaaatcagtaaagcaatagaagaatatccaaaacttataacaataaatatctcaactataaatactataataataatccccacataacacgacctcaaatacctattaaacaaagatttaaatagcaaccacaaaaagacaaatagcattccaataaatgctgtagccataaaataaacttcaagacaaagatataacataccaacaaaaaacaagaatgaatatacagacattttttttccaactcgagaatccagcaacatagagcaacataatccaggaaaaacatatttaactgtagtattcatatttccatataaaaaatacggagttgaggctgatgaaaaacctggtattccattaggcattattatcgtaaacagaatattaataaagaaaaataaaagaacaatatctctcaccagtgataaaaatacaataacttttctttcatccctaactataacatccaaagtcatacacaatgctacgactaaagtcgaattaattattgctgtatatgtactaccatgattcatatatgaagaaactatcaaaatcacatattgaaccacaagccaaaacagaggaaaagataaattaatagtatttttccatatcaatatcaccataaggataatagatataatactttgaaataaatcaatcatttcatattcagacaatatccatgtaaaatacgaaggaatcaaaaaattaaagcaaatcaaaaaaagtaaaatattatatttaaatttaaaaatattcattttatataaactaataattttccatagaacagagcagaaacaatcaattacaattcaataacaagcagaaatatcactatttaaatattttataaaattaacaggagaatatctaccatcataaccataccatatcctacaatctgtcataataaaattatcaatagcacccatttcacgattaacaagacaaatataatcctctctataaaatggagaacaaagtattttctcattatctgttatcaacttcttattataacaaatcgcttctaaagtacgcaacgtaactcctgcattatttttatccattatttccacaataaactcagaacttaagacttctttcaagactgatttatatggcaaccaagtattataaacaattcccttccttcttttttgctttttcttaggtactcctgatatataaaaaattggattacagccgcaaagctccaatttatcataaatacggatcaatttttccagccgatcttttgcaacccccacaaaaaaacatttacgctttatcatttcaacatcacccacatctaccattgaataaacagtaggataataagaaaatccaaataactttgcctccttttcatcatatgtgtatatcaaatcaaaattcttcaacataggctcaataatacgtctcattctataaaatgaatttattaagacaagaaccataatcacattagattttctcttcaacttttcaagaaaattatttctataattacacaatgaaggatctgtaaacagaatcatatattcattcgattgatcaaaatcataatgatctaaagaataatatttctcccaaaatcgttttaatggcaattctattttcatattcaatttaaaactaaaatgaatacgaaaaagcagatcaatcaatacattattaacaaacaatggtttattaataaaatccacattatcgagtttttccaaatctctccacatcaatctaccataatcccgatttggatatactaacaaatatttccgcattactcttatttatctaaaaagatgatttttctgataatctaataacttgcttatagttgatttcattcttagtgagctcaagataaaaaacaccaaggcttcctttgatttctttgtgtaaaaactatttctataatattccatagccactttttgattcaaaagaaccacttcgtttcctaatctaaacaaatatttagcataagtagtcggatttttttgtatatcctttttatatttattatataatgattcccatgcatttttattggccaaactactttttgatatactatctttttgcacaaaagaatccactaaactttccctcaagtaacctatggaataaatccgagcagcttgtaacgcaaaatcccagtcttgaaaacgctttaatgtaacatcaaaacgtattttttcaaaacattctcgcttacatataatcgtttgagtaccaactctatttaaataaagaagttgatcaaaataatctttattatcatccatatctacatttggataataatatttcctattgggatcctccaacataatccgagtcatgccacaaaaggagaaatccaaatttctatcaatcataaattggtattgcttctccaatttatcaagatgccatttatcatcactatcttgaaaggagataaactctcctcttgcagataatgctcctatatttctcgcattacaggccccagatctttgctctaatcgcaaataacgaattctatcatctgcgatctgagtaacaacatcttgggttccatccgtagaagcatcatcaacaataatcaactcaatatctcgatatgtctggtttaatacactatccactgccatacgtattgtctgagcacgattatatgtaggtataacaactgatatcattccacttatgtttaaaatattcaatttttgtacacattttccctacgaagaacagattttaatgtcataataataattctacaatctaaaagaaatgaaacatgttccgcatagtaaacatcatttctataccgttcctctagtgtagcactgttccgttttaaggcttgattatatccagtaatacccggtctaacaccaaatttttttcttataaaatccgtataagtattttcattacccatcgggctaggtcttggaccaacaaaactcatatcccccaaaagtacgttaaatatttgaggaagttcatcgatacttgtttttctcaaaaatccaccgatcttggttaatcgaacatctttttcagaattaaaagtagtaccatcagcattccttacatcaggagcattcattttcatactcctaaacttaaacattttaaattttttcatattacatccatagcgttctgcattataaaagacatcaccatgatcttctaattttataaacaaagccaccgggattattaatatcaaaataaaaggaatcaacatcaaagatattataatatctataagacgcttaattacatttttatacatctaatctattcgatttttcaattcatacaaagcttctttcattgttttaggcttaaagcctaaaaaactaacatagcgatgagtatccataaaagaggagtcaatattttcatctatatcctcttgataatctattgaattagtattttcaaatactgaatttaccgtatttgcaattgacaaatttgtataagcctcttgcataccaacattcaaaatgattgattcctctttctgcttgattgcacacaaaacaaaagtctcagccaaatcatcaacataaataaattgacgtttagctacactcttacctttcactatcaattgttttccttgatatgcaaattcgatgaaattattcatcatgcctttacgcttttcctctaatcccaaaacttgagcaattctcaaaatagtatatcggaatttaaacttacgggtataaaaagcacagagatattcacaagatgcctttgatatcccataaagagttttaggagaaagactgatatcctcttgccacggtatttttgttgtatctgaataaactgcaatagaagaagcaaaaaccagatgcttaatattcaattcattcattgccaataaaatattttcagtaacaatctcattcacatgataatcggaaatcaagccttgtgtacctcttgtagccgctaaatgaataatcacatctacattcttcaatactttatttaatgaatctactgaataatcggtctttacccatcttactttattatagagtgttctatcattttgaactcttgacaacgcaagaatatctatctcatcataatcagcaagtttttccaatacttttgagcctataaatccacctgctcccgtaatagcaattctcattaccaaaaactcctttatagactatggataaaataccccaccttgtcaaaacgtccatttaccggacgtatattatcacctgtcgcataataaaaaaaactgtcctccgaatctttgggtatcaagaaagcagattgatccattattgtttttggcttttggcaaaagaaaaccaactccatcggtttaatatccgaattcaaacattttagttctgaaatatcatcatatagcagatgctcaaatactaacttcatcaaattaacccctgtagatctagccaataaattccacatatgacatccatccaaacgtggtgtcatttctatgatgtacggatgaccgttcattactttcatctggaaataaaccggaccattcaatattccaatccgattacaagcatcttctacgattctttttattttagaattagctgtattacaaacggctttacttggaacaatatgtttatgtatcaacccggtatattccggccaagtatcccgatccgaaacaattaagaatcgcattactccgttgaccatataaccgttaactgaaacctctggcccttcgatgtacttttcaacaataacttttccctctctagaatatttaaccacatcttgaaaatgagactcaaattcagattgtgaacgaattaaaaaaatacctctttgcccttgcgcatctgatggttttaaaatagcaggatattgaattgctattttatctatagaatctaacacttgaaaaggtatatttccttcacattccaatgttagtctctcacgcatcaagttcttatgattacaaacattcgctgcataagaagaaacaaaatgaggtaatccaagtctctcactcaatcgacatgctacaggcatcgctaagtctgatcctgttgaatagaccacatcaattttattatcaactataaaagttgctaatttctcctcatctaatatattaatcaaattaaaatgatctgataaatccgcagcaggtccatctttagccattgcacatgtgaatgtctcacatcccattttttttaattggctaactgcatccatttgtactgccgcaactcccaatattagaactttctttcccatcatttttattagtagatctcattttaaacattccttcacacactcaatcacataatccacatcttcatcagacaagcaggtatgaagcggcaatgtcacaacatttttaaattgcttataagcatttggatagtcctctatcttgaaccccaatttcttatagcctgtgtgcataggaagcggtttataatgtacattggtcgcaactcctaatccggccattttctctataaatttgttccgttgttcggcatctttgtcattcagatttataatatataaatgtccagaagagacaatatctgaagtataatgcgttaccaccgtaataggtagccccttcaatcctttattataacggtctataatttcttttcgacgggacaaaatctcatcatacctttttatttgtcctagacctatgcccgcacagacatctgtcatattacatttataccatggcccaataatatcatactcccacgctcccaacttcgtttttgccaaagcgtctttactctgaccatgaagactcaataacatatattggtgatataactcatcattatctatcccttcaatatctctccaaacaaccgcaccgccttccgctgttgttaggtttttcaccgcatgaaatgagaaattcgtaaaatcggcgacagaacctattgggaattttttatatgaggctccaaaagaatgagcaccatcagccataacaatcactcgattcaaggctttttgaatcgggttatcatttggatggaataaattctttttccgttctactatatcgaaaatcgtatcatagccacaaggaataccaaacaaatccaccgggattatagcttttgttctctcggttatcgccgcttctaatttctcataatccatcgtgaactttccatgctcacaatctatcatgaccaatcttgcccccacatgctctaccacacttgcggtagctgtataagtataggctggaacaataacctcatcaccgattcctatacctaatatacgcaaagttatctcagcacatgccgtatttgaattcaaacaaacagcttttgaggtatgacaacgttctgctaccagctgttctaattttttagttttaggtccggtagttatccaaccggacttcaaagcatcaacaacttcactgatctctgcctctgttatatcagggggactaaataatacgtgtctcatgactctttataaatttccttattatttctttttcttattctccgcctcaaaaccatacccatagccgtatccataaccataatgtttaccatagccataaccgtatttcttaccataaccgtaaccataggtgttcttacgtttgctcaggtcgattccattgatcactaccgccaacttgtcaaatttatgctcgtccctaagaacattaatgtagcagaaagcggctttcggggtcacgtccgcacggcagacataaacacacatgtcggccacacggcttattatggccgtatcagttaccataccgatcggggctgtatccagcaacacgtagtcataacgggatttcaattgctctatcgccttctccaaggtatcacgggctaccagttccgtcgggttcgggggaatcgttcctcctaaaaggatatccaggttcggactgatgccggaaggctgcacaagatcaaaaagatccttatcctccggatccatcagataattagatattccttcctgccttttcgataaatcgaagaccttattcaagcccggcttacggatgtccataccaaccactaccaccttctttcccaaataagccaagctgacagcgagatttccagtcacgaaagacttaccttctccgggctgcgtagaagagaaaagtatgaccttttgatctttccggagcataaagagcagattggtccgcaaacctcggaaggtctcctccatcatgtcgttcttattctcgcgcaccacgatcgctcccttatcggaggatttatgaccacacaagggcaattcgcccaaaatcggaacattcgtcaattgctccacatcgccacgattctcgatcttatatttcaataattccacgacaaagatgattcccaccggaataaacaggcccaccacaaacgcagccaataaaaacacgagcttcttgggagccacaggatccttcccgggtaatggttcctctacaatacgaccattattagccgtggctgccaatgtgatcgcattttcctcccgcttctgcaacagcatgatatataaagtcgccttgatttcttgctggcgagaaatagtcatgaactctttctcttgctttggagcatcactaatccggctctcaaatttactagcctgacgctcaatatctttctgggcgatttgtagtcctcgcaagacactattcacggttgtctcgacattacgtctcatcgcctcaacgccggtgttcatgtttatcaccgccgggttattttccgaagaggtacgtaataaacgtttacgctcgatgatcatcgtgttatattgttcaatcaccctagtgaggttttgatcctgtaaccctacgtttgcaggaattatctcttccttgttgaccggatcgttgatataggtacgcagaaattgaaccaagctgatctgtgtagcgttctccgtacgttgctgctcatacttggaactctcttgtaaggctagacgggcatcacttgtcaaatccgtcagaccggatcgttgcttgaaatccgccaactcgctctccgccgtacccaactcatggttaattataccgatacgctcctctatgaactcagcggttttctgagctacctcattcttctcatcgttcgcgtcttgattatagaacgcaaccaaacgattcacgaaatccacgcctcgctcctttactgtattgttcacgctgatcttcgctatcgtcgtggtctgggaagaggcggtcacgctcaagtctttcatataatcctcggcggtctccgtcggcgtatttatggtaacacgtaaagcgatttcctcttcttccatatacaaggtatcgcctcgcgtaaagcttaaaacacccacaggtgttggtaacaccgccggcaattgatcaaatgcctgttctatctcttgctcttccttatcttgcacatattcagccttaacagacaattttcctgtttttgtaaatgtaagatccagcttaatcggctcctccaatttatcggcctcttccggtgtcatataaatccgcaccggactattcttataaagaggcatcgcataaccgaacgctcgcttttccgctacacgaacatataaattcaggtcgttcacgactttttttatcaatgtacgggatttcaatatctccacctcgttatcaaaattatttgtcatggaaaacattcccaaatcttgaatggccgccaacggattgttgcccgaaccgcttcgcttatcctcctcctttatcaacacggaactggaaatgttatatacaggcgtttgataacgaagaaacaggtaagtagcgatgcaacatatcaatatactagcaacaaaccaacgccaataaaaaaggtatttgaataaaagagcgaccaaatcaatctcttgttcctcgttctctatcccagtgttattaattatccgttcgtctatcatctctcttaattttcaattctcaattttcaattttcaattacttaagtatgtttaccaacaggccggcaatagataccagaatcgagagtgagcttacccaaagggtcgtgctgttaccgatatcggagttcttagccttcgtcttgttcggggtcacgtaaataatatcgttttgcttcaggtaataatacggggaagtcacgacttcggcattattcaaattcaagttaatgatctcacgcttaccgttcacgtcctcacggatcagcttgacgttatcacggacaccgtaaatcgtcatatcgcctgccatcgccaaagcctccagaacgttcaccttctcgttgccgatcgtgaagctacccggacgggccacctcacccaacacggagatcttgtaattagccatacggaccgtaacgatcggggattccttcaaataaggtttcaaacgctcacgaatcaagtcctccgcctcgttcttggtgagaccacccacttccaagcgaccgataacagggaaatcgatctctcctttattattcaccaagtattgctgcatggtcggttgtgtggtcgtactgatatttgtcaaagccgcattgattggagtctgtaccgtcaagttgaatggagtcgcagccttcgggtctgtcgtattgaccgtgatgctcaacaagtcttttggcatgatcttggcgtcatacaacggaagggtctcctcaaaatcgttcactgcctctgggttttggaggtatggtacgttcttgtaagaagtacaactcgctaccaatagaggtagagctaataaaagtagtaatcttttgattttcatattattttgttatctttttttttatttcttagaacacagaatgatatggatttagcgaaacaaacgagagaaaaggcctttcggtttctccggttcgtattccgactcgtatttccgcattaaatcctcataggaaagtcttttactcaccatctcgtaaatcataccccagtccgggagaccaccaagattacggtcatcaataaaaatatcggccttcagcttacgggagaaatggttattcaggcttttctcttcctccgggtaatctcggttcacggcgtaaaactccaagccccgctctcggcaaaaggtgacagcctcatccaaaagcttaccctctcgcacactccataagatcagcttgtggtgttctgtttgtaactttctcaatgtctcgaaagcgaaagggatctccttccctatcgccggatatttatgctcaacgattgttccgtcaaaatctactgcgataatcatttataattcagatttataactaccaactaaattgctaattcactccgtccaatctcgtgaattgagagttttggctcttgaactcggggacgaaggatttcatctctctcaccataggaagaatgtgtacatgaagggataattcagctaatagatcaatgtgctctaccacatccttgtaggcgtactctcggactgctgccacacgaatcttctcatgaggggtttccttcgtattctccttgttgctcaatagttcctcatataatttctcaccgggacgaagacctgtgtatttaatctctatgtctttatccacctgcaaaccagaaagctcgatcatacgcttcgctaagtcagcgatcttgaccggctcacccatatcaaagatgaaaatctcgccgcccttgcccatcgtaccggcttccaacaccaaacggcaggcttcggggattgtcatgaagtagcggatgatatcgggatgggttaccgtaactgggcctcctttggcgatctgatcgcgaaaacgaggtatcacggagccattacttcctaatacattaccgaaacgggtcgtgataaacttagtgtttcccgctagagcccccttactgatcgccacactcaagctctgcacatatatctcagcgaggcgcttgctacatcccatgatattcgttggattaacggccttatccgtactgatcatcacgaatttctctacaccatagcttacggcggcatccgctatcactcgggtaccaaacacgttggtacgaacagcctcgcaagggttctcttccatcaaggggacgtgcttataagctgccgcatggaatactacctggggatgccaattgcggaatacgtaatctacacggtccggattccggacatcgcctatgataggtacaaaatccagttccttatacttctcctccaattccaggcgtaagtcatgcatcggagtctcggcggcatcaaggcagatcagtttcttgatcgggaaatgcgccagctggcggcagatctcgctaccaatgctaccggccgctcccgtaacaaggatcgtcttatctttcaataagagaccgatctcgcccagatttatactgatctcctcacgacccagcaagtcctcaatacggatctcacggactgaacgcttcattccgccctcatggacctcctccatatcaggaaccacgagaggcttcaaggaggcctgctcgcaataatgaatcaaacgatcacgttctcgtcggacggtctttatattcgggaaaaggataccatccaagttatttctggggatcagacgcaacaagtcatcaatgtcctcgatctggtaaacgggaagttccgctatgcgaaggttctttttagcgctaccaaacgtcaagaagccgatgatgctataattttgcatgaatacttgccggttgggtgatgtggctatcatcacgctatcctcatccataccgaacaccagtacacgcttgcgcttttttccaagttgggacaacacgctattatatacattaatcacaaatacacgtaaggtgatcagcagaacaatcgtcaacatacaatcggttatccctcccacccaatatatagaggaattgaaatccgccctcaaaagatgaagcagtatgaacatgaggatggattttgtgatggcgacaccaccaatcctccatagtccacgtagcgtggaatgacggatcaccccgtgataaaccttgaacgtaagaaaagaaaggatactggccacaaaggaagctattcctacctttaatacactaatcccgcttatgtatacatgcatgatggacaataatcccagcactcctatcaaagatacacatagggaaatgaaaagatccgcacaaaaaatgatccagcggttgatataccgcaaatttaccagacgccccagcgctaaacgccagcgattataacgatatttcaccttttccatatttgttttattcatatctatctaactataataataagcgaccgaacctctcaagtggttggagtggtataagctaaagcaagagtctagtctatcggttaaagaaaaagggactctcctcgctactagagatagctgacctcttgatcgatatcggccgcctaattctcattttctaattgcgacctagcgataatatattcttgattggaggctctcttgaacctcagaagtatctttaatcaatctccatgtcacgatccatggacgtggtttttacttccggcatcggaaaatacctcacctcttccttatgccactccttgtaaccgtcaagcgtacgagtagggacggataaccgaccgtagtcattgccttcgcgatggaaaagatggttacgtgtataggaacgtaactcgccatctgtccaagagaccatcacgattggaaacgggtacgtggtgaggcttaacggggtcactaaggtacgggaagatatttggcgtaacaggtaagctgatttctcgaacgccacccaatacggacccgtacagtaaagatggatgaaggcacgattatccgcctctcgcttaagaatctctttcaaatggtttcctaacaacgagataaggcgtactccggatctatcctcttttttaccgtagtgcgtatccatctatgtgtatcataatagctctagcaggtcacgggtgatatttactttggcacatcccagtagatctacacggatcacaaagttaagattgccatcctccacttccagcacgttaccttctagaccatgcaacttaccgccgttaatgcgtaccctcgctccaagaggcagcggacggggatcgataatgacaggctcttcggaatcgtccagcatcctacggagtttcaccatctgctcatccggaatgaaggctacggggcgtatgcctccagaccgttcgccagctatgtttaccatgaaacgtttgatataaggaagatgaacgatctccttcctacgcaagacatcggtgcaacggatgaatacaatggaacggaagacgatccggtctacttgcttacgcttgccgcttggcagaagacacatctctttttgggaggctatataaacctcatagtccttctcgccttccggctgactggctatgcgcttttccagcttgtcacggcatagtttctcggacttgttgttgacgatagcgatgtaccaatgtttctgatcagattttcgccgtaacgggttttcaggaatggttctttcaacgcctacggcgtcgataccctcatgaggtaccgaatttacaaccgtttttacaacattcgctcgcatctcgttgattgcttaaaagagatagtttgatatatgcaccataaccctttttcgccatgtgagaaattaggctacttagtgagtagcgtacaatggaagatattatcacctagcaccaagcaaacgctgtcatcaccgatgaactcagcaccaatagtaaatgcctgcgccaatccattcggcgatggctgctccgcatactcgaaacacacaccataatcagagccatccccaagcagacgcttgaatccgggcaaatcgtatggcgttgatatgatcaagatttcccggatacccgccagcattaacacactgataggataatacaccatcggcttatcaaaaataggaagcaactgcttgctcactcccttagtgatcgggtataatcgggtacccgagccaccagctaaaacgattcctttcatacgaatattctctatatcattcacacacttttttatctcacccttcccccagcacatacttcctgatcccataccgaatgctcggtacattcgccccgttcacgaacgtgaggtgaggcaagagggcgctgatgaaggcacggctcttgaccagcttgaggggagacgagtagtcggctaggatctcgttgtaaaggtccgtcaataccgtttggcaaagggtgaccgtgtccgggcaggcgcataggcgggcctcgtagacaagacgggtcgcctcgtccgggatgaacaacgccaacgaggagggttcagccgtcaccggaggggcaggagagtttatcggaggagacggagactcatgaagtcccgattccgcgggcgtaatccagcgttccgtccgtgtcaccgtcccgtcaccccaatggatgttctggatagcgatggtggcattgggcaggatctgcacgttacctccattgaccgtaaaggcagaacgtgcctgttccgcccgctcttgattttctgtcatatccgtttttaatttaagtgttaacaataatcacccttttcacgggggatatttatttctatcctcatttcatccaccatacgtccgtttccgtacccgtcccgtccatcgctattccgggaacgggcaggaacgcattcctttaccggcagtaaccgaataatcaatttattttatccgatcatgaaagagtctatcttttcctttttcaacgcccccatcaccaatcaagtaccgaacggggtcgtctgtgtcagtcaattgtacgcctatatcaccaccagcgagtggctgcgtgagcgtaccgatcaggtacgtgccgcatcgagcgacgagaaacggttcaggcggctgaaacagagtttgctaccctatgtcacgcccgccggtatcttctcctaccgcaaggaagatcacttgctcgtgccctcgggcgagttcgtcatcgacatcgatcacctctcctcacccgaagaggcgatctgttggagggacacgctgttcgccgatgagcggctacgccccgatctctccttcgtgagtcccagtaccacgggaatcaagctcctcgtaccctatcgcctgtcgatcaagaaaaccgtagaggagtctttcgacgaggcggtacgattcgcttgggaataccttgagtggaaatacgggctgaaagctgatgccacgaacgcagacctctcacgggcttgcttcctttgccacgatccctcagcgaggctaggagaccggaattgttgacagaggacaagtgacagttggtagttataaatcattattcaccattcattattcattcatcatgaacccattatcagatctggagcggctcgttgccgccatcgagaaacagggggcgaacatcgctcccacctatcaagagtatatgccgatcgccttcgccatcgccaacgattgcggagaggccggccggacattctttcatcgtatctgccggatgtcggagaaatatgtctctaccgaggcggataagctatacgaccatgccctcaaaggaggcaatggacggaatggcttgggatccgtattccacttggcggacctagccggcgtgaaactggacaaatccatggccgaggccgggaaactttcaaactttcaaacattcacgcctccttcacacacgcacacgtgtacgcacgaggaacagtccgtgaaaaatgtcccgcccgcctttccggagtatccttggcccgctttcctcaaacggatgatcgaccggggcgatacccccgcccaaaaggatatcctcctgctgggaggtatcaccgtgttgggagcgacactcaacaaatcgatccggatatcgtacgggcgaaaattctactacccttgcctgcaaacgttcatcgtcgcccctcccgcctcgggaaagggagccctcgcttggacacgccggcttgccgagccgatacatgaggcgatgatggcgaactaccggcagaggcataaagcttaccgggaggagaagagccgttgggactcgctgggcaagaaaaaatccgatacgccggagcccgagatgcctcccctcaagatgttccttatcgccggtaacaattccggcaccggcgtgctggagaacctcatcgaggccgacggcatagggctgatctgcgagaccgaggccgataccgtgagcacggccatcggcaccgagcacgggcactggagcgataccttgcgtaaatgccacgaccacgagcgactggctttcaaccgacgcacgaaccgggaataccgggagtgcccggcctcttacctcagtgtcttgttaagcgggaccccggcgcaggtacggccactcattccctcggccgagaacgggttgttctcacgccaattgttctaccggatgccacccatcgacgagtgggcggatcagttcgagcagggcgacgaggacatggatagcctcttctccgattgggggaagcagtggaaaatgctcgtggactacctgcgtgagagggtcaatatcatacaattccatctctccgacacgcaaaaggagcgattcaacagctgcttcgcacgcatattcgggcacgccggcctttcctacggatatccgatgcgaagctccgtggcccgtatcgctatcaatatctgccggatcgcttccgtggtggccttcctacgatcggtggagagtctcctcatcccacaagccattctcgattctcagttttcaatcctcaattgtcccggtctctcgcctgccctcgagatcccggaggagaacgtacgggacggtatcgttccttccctagagttacgtatcaacgatgacgattttaaggctgtcctctcgctcgtggagccgctctaccgtcattcggcgggcatactctccctgcttccgtctgacgaggtgccacgctctcgcacgcccacgccccaagaggctctcttcgcggcccttccactctctttcaaccgacaacaggccttggaggaagcagagaggaacaacatccccaccgccaccctagatacctgtctcaagcgaatgcaggaacgaggcacgctggagaagaacggccggggcgagtacagcttcggcggccgtgtcacccataagtaatcccggcctccctcacacccctatataacgtaccccacgggcgtgtgtgtgtgtgagggggggacgaatgtttgaaagtttgaaagtttcattctcccaaatctataaatcataaatcaaatgttcttgccattaagaaagtccgcactagcggcatcctatttcccggagctggcctcccatcaagcttgcaaccgcttacgtcgttggatcattcgatgcacggaattgcacgacaagctgctggagacgggctaccgccccgagcaacgtatattcacgccccgacagatcagattaatcatccactacctaggagaaccgtaaattagttgacagttgcgcacagaggtaaataaaaacagcctactgtcactagtcaactgtcaacttggatgggtattctaagatctttacaatgcccatccaaggcttcttataatgcctattcaaaggggcttacgataggcagcgtaagaaaccggcggttatcactgcgtcccatgttaattaatcgttattccctaccccgggcatcaatcggcatcaccgccccttacggcggaacctatctttgtaacattgatcagcaagcaattaattttctattattaatctttaattatcaaactatgccacaagcatttcaagcacgaaagttttttatccccaagacggatcctaagcttcatcggtgatgacagcgtttgcttggtgctaggtgataatatcttccattgtaatggatttaccttgatgctaaaggaggcggttcgtactgcggaggaagagaatagggctactgtttttggctattgggtgagtgatccggagcgttatggcgtggccgagttcgaccaggccggcaattgcctgagtatcgaagagaagccggagtgtcccaagagcaactacgccgtggtcggattgtatttctacccgaacaaggttgttgatgtagcgggtagcattcaaccgtccgcacgtggagagtatgagatcactacggtcaaccaacgattcttggaggatggagcgctgaaagtccagactttaggccgaggtttcgcttggctggataccggtacgcacgactccctgagcgaggcatctacatatatcgaggtattggagaagcgtcaggggttgaaagtggcctgcttggagggtattgcataccgtcagggatggataaccgaggagcgtatgcgagagctggcgcaacccatgcttaagaaccaatatgggcaatatctactaaaggtaattgaggaattaaaggagacaggagatccgaatttaggttaagatggaggtaataaagacagatatagagggtgtagtgatcattgagccgaaggtgttcgatgacgctcggggatactttttcgagagtttctcgcaacgtgagttcgaggagaaggttcgtaagataaatttcgtacaggataatgagagtatgtcctcatacggagtgatgcgtggcttgcatttccagaaacctccctttactcaaagcaagttagtgcgttgcgtgaaaggatgtgtccttgatgtagccgtggatattcgcaaaggaagcccaacgtatggtaagcatgtggctgttgagttgagcgaagagaatcatcgccagtttttcgtgcctagagggttcgctcatggatttgcggtattgagtgagatagctgttttccaatacaaatgcgataatttctatgctccgcaagcggatgggggcatccgtataaaggatgagagtagagcactggtctccaaaaccaggtgtcgggagttcgagcctctccttccgtgcatgagcggtaatactatgaatatgtgttgccgcttttttattattctccttctcttcccattgcgataaaaaagcgtaaataagacaacatttttcgttaaagagactattttttctttcaatatataaaggaatatactacttttattgccgattttaaatctaattgagacttagtgtaaatcgtataccatagaaacagatgacaactaacaaattttcaaatcgatactcgtctgagaggaaaaagtattttttcaaaagtaaggcgtttatcctgttcctcggattatttttgggagctgggattatgatcgccctttataaaacatctgtatatttctcgacagatgaatcttgtatgatgtgccacgtgcatcctcacgtagaaaacagttggaaactttccaagcatgtaaataatggaagtggcgttaagacacattgcgtagcttgtcacctcccaccccaaacaaatacttggaaacattatagcgcaaaggctaaattgggtatgaaagatgtttggtcatacttgactaaagacagcgcggatttcaattgggaaactaagtccgagttggaacacgccgttaaatatatccccaatgaatcttgtaaggagtgccatcagaacttattccccgaaggaattaccgatgatggtgtaacggcacatttatattatgatgagaatgagaaaaagctagatctacaatgtattagttgccatttggatgcaggacattacaatccgaactacaatcactccaagatggttggcataccgggacaaaacacacccggggcaacctcgatagataccagcctgttttttaaggaaccaactacagttacctctttcaccgactatgtagaacaaattcccggaacaatggtctcattcaagatgattgctatccccggaggttcattcaaaatgggtagtgaggaaaaagaggcatttcataaagcagatgagtcgcctgtacacaacgtaactgtcagtccgtttttcatggctgaggtcgaggtgacttgggatcaatactgggctttctatgggaatacgatgagtgagggccgtaccccgccagagaccgtgtacgcaaataacagtaatccgaatgtcgatgccatctccggtccgacacctccgttcggtttcccggatcaaggctggggtggcggagatcgcccggctattacaatgactcattatgcggccgagactttctgccaatggttatccaagaaaacaggaaagacttatcgtttaccgaccgaggcggaatgggaatatgcggcacgtggcggcacggaaacgccttatttctttacgggcaatccaaaagatttctccgatcaaggcttctggcgtaaatttttcgacgcaaagactgatagtataggttcttatgtgatttatagcaagaacagcaaaaataagacgcaagaaccggatttggtaaaagccaacccttttgggttaaagaatatgttgggtaatgtaatggaatattgtgccgacaagtatgatcctgaagcttacgctaaaagcggaagtagcgccacagatccattagttactgaaggtacagaatgggtagtgagaggcggtaattacacctccgatgcggcagatcttcgctgcgcttcccgtgattataccaaacatgaagcttggttaaaaaccgatccgcaacaaccgaagagtatctggtggtactccgatatcagaggaatcggtttccgtgttgtatgtgaacctaataaatagtgtctaaaaaaaataatatcatgaaaaaagagaacagcattagcagaagatcatttctgaaaagttcagccctagcgggtgcgcttggagcaattggaacaggtagtacagttggtgtattaacttcttgtggtggaggtgaaagtgcgaacgcaataaagcctttgaaagaacccggtacttattacgtgcccgaattaccagatttggcgactgatggaaaagaactaaaagctggtgtaatcggttgtggcggacgtggttccggagccgcttttaacttcttgaacgctgcgaacggcgttacgatcgtggctttaggcgatacgttccaagaacgtgtcgatgatttggcaaagaaattaaaagatgagaaaggaattgatgtaccggctgataaacgtttcgtcggcttggatgcgtacaaacaagtgattgatagcggcgtagatgtagtgatcgtcgccactcctcccgtattccgtccagttcatttccaatacgccacagaaaagggcaaacattccttcttagagaaacctatctgtgttgatccggttggttaccgtaccattatggctaccgcaaaacaagctgcggcaaagaacttatgtgtcgtaaccggtactcaacgccatcaccaacgcagttatgtcgagtcttacaagaagatcatggaaggattgatcggtgagatcacgggcggtacggtttactggaatcagaatatgctttggtatcgggatcgtcaaccgggatggaacgattgcgaatatatgatcaaggactgggtaaactggaaatggctttccggcgaccatatcgtagagcaacacgtacataatatagatgtattcacttggttcagcggcttaaaaccagtcaaggctgtaggtttcggttctcgccaccgtcgtatcactggcgaccaatatgataacttcagcgttgatttcacaatggaaaatggtatccatatgcatagtatgtgccgccagatagatggttgtgcaaataatgtaagcgaattcatccaaggaaccaagggatcatggagcagtgacacgatggagatcaaggatttggcaggaaacgttatctggaaatatgatagcgaggccgaaaaagcgaacttcaagcaaactgacccgtatacattagagcatgtaaactggatcaactgcatccgtggtggtaaacaaatcgagcaagcttctgagactgctatctccaatatggccgcaatcatgggtcgtgagtccgcttacacgggtgccgagaccacttgggatgccatgactgcctcagcattggattacactccgaaagatttgaacttaggaaagatggatatgagcggcttcgtcgttcctgttccgggtaaaccaatcgacaagaaataatccagactgtttatgacattaaatagaagaaactttttaagaacctccttatccggcgctgctttagcggtaggaagtacggccttggcctcctgctcttccaagccggcaaacactgccaaaggagaaaaagggagcgacaagcccggcaaggaccttgaattaaagctttctttccaagagggaatcgccccgggtgaaagtttgaacgagaaacttgattttatggagaagttgggcgttgtaggttttgagccgggtggcggaggattagccggccgggtaaacgagatcaagcaggccttaaacggacgtaatatcaaagtgagtgccatttgcgccggcttcaaaggctttattctttctaccgatccagccatccgcaaggaatgcatggacacgatgaaagagatcatcgccgcagccggtgaattaggttctacgggcgtgattatcgtccctgcctttaatggccaagtccccgccttgcctcatacgatggagacacgggatttcctttgcgagcaattcaacgagatgggaactttcgccgcccagcatgggactagcgtcatctttgaacctttgaaccgaaaagagtgtttttatctacgtcaagtagccgacgccgcctctttatgccgggatatcaataatccgggtgtacgttgcatgggcgacttctggcatatgacatgggaagagacctctgatatgggagcctttatctccggtggagagtatctccaacacgtacacgtggccagccgcaaacgtcgcagcatgccgggtgaggatggagatgccgataactatatcaatggcttcaagggattgaaaatgattggttataacaactacgtaagtttcgagtgcggatgtcagggagaccgaaacgtggtagtccccgccgccgtcaagttattacgtgaacaatgggaacaagcttgataagatgcctttagtatatccaaatatgcaattgagtgaggtggtggaagaacacccctcactcattcccgtaatcaaccggtttgggattcgtctcgggcttggcgacaaatcggtgaagacgctctgtgaagaacattcgctggatacggactttttattgacagtgatcaataccttcctcaacgaggagtattttccggagaagaagttacaaactttccatacatcgcagatcattgattacctgacaaagacgaaccaatactatttacgttatcagctccctaatatagaacgccatctaggttcctttatctcgatgagtacgcccggcaatcctacccttggattgataggacgcttcttctcctcgttcaaggaagaactcatcgcccgcattgagaaagatgataagatatggtttccctactgcatgtcgttaagtaaaaagctgggaaaagaaccggcgggaacgatcgatggattgcaaatcacctccgagcaacgtacggaagataccatcgaggcccttttagccgacttaaaaagtatcatggtcaagcatctttcgggagattacgacgagaatttatgttatgccgtcctcttctccatctgtagtctggagaaagacatcaaacaacacaaccggatccggtatcgaatccttacccccatggtctcggccatggaaaaattatgtatctaacgatctgaaatgcatcgaaacaaacaaatagcgatcatactgtctgatactctaagaagtattgggctgcaaagcttgctgaccgactacttccccccggtagaggtttgctattttccaaatttcgagatgctttcctccacaggaagcgacacctacgattactatttcaccgattcagatacccttgtgctcaacgcagatttcttcctcccgagaagaaacaagaccgccatcctcatcgacagcaccgaagaacacggggcgctctcgtctacgaaccgtatcacgttacgttcctcccaagagaccattatcgagcaattgcaacaattatttacgagcgacagctccggcaacaccacaaccgaaaacaacaaggacctatccagccgtgaggtagacgtacttcaactgatcgtaaaaggcatcacgaataaagagatcgccgataagctgaacatcagcttgaacaccgtccttacccatcgtaagaacatcaccgccaagctgggcatcaagaccgtatccggcctcaccttctacgccatcatgaacgggatcatctccggcgacgatatcgaactatagcgaaaccaacaaaccagctttcaaaatcactacatctagtgattgaccatcctgtttctttaccgtttcttcgcgattgaaaaaatatactaacaaaagaaattcgatgaagagacactacttaggtatcatcgccctaggtgcgttggggctgcaaaatgtatacgccgaggacatcaaggctaacgagaacgacacgataaaaacctataacatgggtgaggtaatcgtgacctcatccacgaaggagacgaataacctccgtacgttacccggttccgtatcgatcctttccccgcaaatgatctccggtaggcagatcgacgcattaaaggatataagttctttcgtcccgaacctatacatgccggattatggggcaaaactaacctcggccatctatatccgcggtatcggagccagaagtagcggacaatccgtgggcttatatgtagacaacgtgccttatctggataaaagcaccttcgatttcgagctgaccgatatccaacgcatcgaggtattacgagggccgcaaggaaccttgtatggtcgtaacgccatggggggcatcgtaaatatctataccatctccccgttcgattaccaaggaaagaaactctccctatcggccggaagctacgggcaatataaagtcaaagcctcccattatgctaagttgagcgagaccatcggattcaccgccgccgctttctatgaccatagcgacggtttctacaccaatgcctacgatgggaaaaagatcgataaggaagacaatgtaggcggccgattcaagttagaaggtcgcttcaatccgagcttccgtgcctcctactccctttccgtagattatacggatcaaggagcgtttccatatggtatgttcatcggaaccggaaataccgatcacaagtatgtaaatcctatcaatatcaacgatcccagctcttataaacggacggtcatcgccaataacctgtccctcgaataccggaatgagcacgtgatactgagcagtatcaccggtcatcaatatttcaaggatgatatgaagatggatcaagacttctcccctctctcgatctttaccctcaaccaaaagcaaaagcaaaacgctttcagcgaggaattggcgatcaagagcaacacgaggaataattaccaatggtccttcggactctacggtttctacgacgatctacatacggacggcccggtcgatttcaaggaagacggaattaagaccgttctccagcccgtattcgatcaattgaagaaagatcaccctaaaatgccctatctaaaaatactggacgatcatctttatattccgggttctttcgacaccccttcttacggccttgcattgtatcaccaatccacttataacaatctgttcacggaaggcctgtcaattaccgccggtatccgcttggattacgagaagcaaaagatggattacaattccgaggctaagatgagaatggggttcggcttcgtagaaaacggaccggttatcgacatcgagaaacttttcccgatcccaaccaccgtgatggacgccagtgtctcccaagacttctggcaagtacttccgaaaatatctttaaagtacgaatgctcgccaaacacgttcacctatgtatcggtagcgaaaggttataagaccgggggctacaacgtacaaatgtcggcagacgtgatgcaaagccagatgcaatacgatatgatgagcgctttcaaggacatgatgccgatcgaggtcaaagaacctacccccatcgaggaagtagccgcctacaaaccggagaaaagctggaactacgagatcggtatccgtagcgagttgctattccaacgcctaagcgcagaattgacaggtttctatatggacattaaagacgtgcagctgaccaaattcgtaaatagcggaaacggccgtatcctcaccaacgccgggaaagcaaaaagctacggtatagaggcctccttgcgtgcccgcatcatcgatgggctaaccgccgacgttaattacggtttcacccatgctacgttccgggattacaacaacgggaaagaggatttcaagaacaacttcatcccatataccccacgtcataccctcaacgtcggactgcaatacacccgcctgttccgtaacgcatggatagaccaattctccgcctccgcccaattcagcggtgtcggaaagatcttctggaccgagcgaaacgacatctaccagaaattctacggaacggtgaacgcaaaggtaggcgtacgcaaaggtatcgtcaacgtaaacctatggagccgtaatataacgaacacccattactctgcattttatttcgagtcattcgggaatccgtttatccaactaggtaagcctttccagatcggtgcggaggtggcgatcgccttttaagcgcaagcgttcaatagaaataaaaaacgggagagccggctattacaccaactctcccgataacatttcacataaaaacaaaatcgatcttttttatctagctattttaaaaatcgtaagaaatatcagcttaaagtactcaaacaatgtaggatggttaatatatctcatattgagttcaattttcgccggcataatatcctcaacataagttttgtcgggatttgaagactgtccaagtaacctattttcatccatatacactatagatgcgtaatctgtaatacccggccggacagccaacacacgcctttgttcagtcgtatacatatcgacatacttacgcacctcgggccgaggacctaccaaactcatatcccctttaagtacattgatcaattgaggaaactcatccaatttatacttacggatataataaccagaccgtgtaatccgtggatcacgccctcctacggtaataagtcccttcttatcagaacctacacgcatacttcgaaatttaagcaactgaaaatctcgattgttacgtcctacacgaatttgcctataaaaaacaggtccggtagaatcacacttaatccaaattgccagaataacaaacaaaggacttagcaagataagacctatcccgctggctacaacatcaaaaaaacgtttcaaatcgattgattattttattgggtaataatatcaacaaaattagaaatcacatactctacgtcctcattcgtaagactggtatgcaaaggaagagtaatctcgttatggtattggttgtaagcattcggataatctacgatatcaaaacctaaatttttataggccgtcatcattggtaaaggcttataatgtacgttacaagcgattccacgttcagccatccgctctatcacagcatttcgatattccacatcctcaccaagcaaacgtactagatacaaatgcccactcgaagaatggtcatcaccaaaatgatccaagacctgcacatcgcaccccctcagtccttcattatacctctcaataatctgacgacgacgatacagcatttccggataacgcttcaactgcgcaagaccaatacccgccattacatccgtcatattacacttataatacggagcgacaatatcatactcccatgctcccaacctcgtcttagctagtgcgtccttgttctgcccatgaagggaaagcaattgaaactgtttataaagagactcgttgtcaaccccatcatgatttctccaagtcaacgcacctccctctgctgtcgtaagatttttcacggcatggaaggaaaacgaagtaaaatcagcgatctcaccacacatctttccatgccatttggcaccaaaagcatgggcggcatccgcaagtacgataacccgaccgtatgccttctggatatcattcactggcgaaaacaaatgtttcttgctctctacggcagcgaatatcttatcataatcacaaaccacaccggcaagatcaacaggcagaaccacctttgtcttctccgtgatcgcatctgccaacttatcataatccatctcaaacgaatcaggagcggtatctaccatgacaacctttgcccccacatgacaagttacacttgcggtagcggtatacgtataagcggaagtaatcacctcgtctcctggcccaacgcccaaaacacgcaatatcaactccatacaagccgtagccgaattcaagcatacagcttgatccgtttggcagcacatggcaattaatctctcaaattcttttgtcttaggccccgtagtgatccaaccggaacgaagagcctctgatactaaataaacttcactttcagttatatcaggaggagaaaaaggaattttttttatactcataacctcatacaagtttataattattattaatcattcaatcaaaatcgtaaaaaacttttttgaatttatcataaatatgatcaaatgttagattatctgcaatatattttttcgcttgcttacctattttttctcttagagaacgatcatccattaattttataatagtatcagccattttttgaaaatcagttcggataaagatatgttctccatcaacaatcccctccagtccttctgctccaatttcagttgtcacaacacagcaaccgattgacatcgcttcaataattttattttgtactccagctccagaatacatcggaacaaccacaacagaagctttcttcaaataaaacttaggatcatcgacaaaccccgtaataataacatgctcagatgcaagtcgacaaacagaggcagatggtcgagagcctacaatataaaaacgaacggatgaatccaaaagcaaaataagaggtagcacatatcgaacaaaagtcgttacagcaactatatttggttcataaaacatagatcctacaaaaacaatatttcgagaatcattaggaataataagttgatcgtcaaaatcaacactattaccgattacctcaatatgtttatttgaaatttctagatctgcatgcctcaaaataaactgacgatcgacatcggatataataataaatttatcaaaagattttaaaactttattctcataactaattaatcgatttgcctcgaatttataaaccagcctccatatccaattcgcttttaaagaagctccaatatagttcattgaaatagcatcaacataatcaattatcttattacacttacttccatcaacgtacggaacggttctaatattattacaaaaaacataatcatacaaagataaatgttcctgtatataactcatcatcctcggagaataaaaataactacattgtaatggtctagatttaaaaaagcccaataatgcgcgtaatacacatttccacttgggctctaagaattcacttatttgtcgacaaaaacaacgcaattcggttagatccgcaaatgttttataaggattacaagtatataccaaatcaacttcaaatatttgtgacaacatccgaatcatttgagatgtacgaatagaagctccgtcttgaactggaaatggacgtttagaactaattacaagaatacgtttacgagaatccatgacacaaataatttgctcacaatttaatcattaggcaattgaaactttacaataaaatgcctctctcttttttcctctggaggcaattgcatataatcatgataaagattggtcaaataccgatcatagtcagcaggtatataaacgatttctccttcaaataaagcctcttttggaggaaaatatacagaagcatcaaatatttctccgttataatattttctaccagtaggaatacctagaggattccctctctttgaagaagccacaaaacgatcaaaccaataaacccatttcgcatgtggaataataccaaagatagatcccagcattttcttaatttggaatcttctctttaacgatgaatctagagatacaaattctgacaaagactcgcttggatattgcgcatataaaaccatgatggatacaaactggattacattggcgataaaaccttttatagcttgtgcgattttatacttaggcactgaatctaaagcaaacacatcaatatataatcctttggggaagggtgaattctcattaaaaagctctatattaaaggagttctttctatatatcttcaagaacacagtttttgcatcagtgtctctattaggatagtcaaactcatatttattccccaatctcccctccttacacaatcgaatcaatttttcataatcatcacgcctcatcattacgtctaaatcatcatcccaaggaataaaacccttatgtcggatagcccccaaacaacttccaccactaagcattaatgtcaagccttctttttcacataatttcgctacatccctgtatatatccaacaaagctcgcttcatggcagaagactccgaagatgtcatctcatgtaaataattcgttttatgagctaactcattcatcaattcactatcagatttcatctttacggtctttttttaacatccaccacttctccggtcagggaagaaaatatagtattcaccgacacagacgcaacaacacttgatttcaacaaggtatcctccggttctatgccaaaatttctctcccgcataggggtcttagtccgttccggattaatacaattgatacgaataccactatcctgccactcttcactcaacgcttgtacaaaattcacgatagcggctttagaagatgaatacaagctatataattgacgccccctcgtataagaactggaagtaaacagcagcagcgcccctttgctcatttttaaatatggataagattcccttgctacaataacagctccaagataattcacatgaatacttttacaaatctcctcatatgtcattgtagccaatggctcccgattcaagactccagccgtattgacaaccgcatctatacgcccttccttatccatgacagttctcaaagcatcagccactagagccgaatcggagacatccactccattctctgaacggctgaaagaatagatatgcgccccgtactggcgacaaatatggataatatcaagcccaatcccatagcttccgccaaaaacaacaataaccgatgaaggcaaagcggctatagtcttaggagttaccgtttcattctgttgagcgattgattttagctgaaacaacttatccaataaaaacagatcttctttgtaagtcaatttcatattaaactgttcacccttgactacatacacgaattcttccggaagatatctgtaaacaactccacaatcatctgtcgtttgaaaatcaagatctttcaatgctaattcataagcccgctttatcgtagaacgtttaaaagcttgcggagtctgcccattacgcaaatactcacgagctggtattcctgtaatatggtcttccacatccacttgaatgattgtatcagtcgtcttgatcgcaacatccaccgcattatacgttttcaacgcattgatgcaatcagtaataatacgatcattgaccaatgggcgaaccgcatcatggaagatcatattcacctcttcctcataagcattaatcgccgctaaacttgaatggtaacgttcctttcctcccttgaggattttcttcatcttggaatattcattcttcaccaagatattctctacctcctgcacataattaggattagaaaccacaacgatctcatctattaacggatgattttggaaaacatctatcgtatgttcaatcacttttttccctgccaacttcaagaactgtttaggcgtcgcatcacctaaacgttgaccgaagccaccggccaaaaccacagctatatttctcatgatctacgtttatatatattaaaatataaataaataccaataacaaatattggataagcatataaggcgcaaaaagcgactaatttccacttcttttttacactcccattaacccaaaaatattgaacatatttcttaaaattcatatcatttaaaacctctttaacaatacgattagctctaattgaaaaaggctttttttgaggatatttaaataacaaagcattaccaacccaagtaaaaataagttctttatacaaagcattttctttcaaataaattttatttttttgcaccaagaatttttccatcatattcacagtatacagtacatctttatccttctcttttatcgtattaattatactatcttttctattccatctataataatagtaaggagaatccatcacgatcaaagaagacgaacaaatcaaagccttaaacacaaataatagatcctcatataaaacacctgtatcaaatcttaattcatttttctccaaaaatgatctattaaagaccttattacaagaagaagctgtaaaacactcatttttcacacaatgtagcaaataagattcacctgtttcaaaacaagttttccccttacttatagggtcttgcatataaacctcatcagcaaagcgatatcttcctaatacaattatatcaacctcattattatacgataaaaccgcctctatttcttcacaagtattcaaagatatataatcatccgaatcaacaaacagaatataatctcctactgcattatcaataccaacattacgagtatatcctaagcccatatttttttgatctataacacgaattctatcatcaatcctactatactcttcaattaaagataaagagttatcactagagccatcatttatcactacaatctcgatatttttatatgtttgatttatcaacgagctcaagcactcattgatatatttctcaacattataaaccggaacaattattgaatactttcttttcatcatttacgaacagataaaacataacaccagaaaaaaattcctcctagaaacaatgtgaaaatcagaaaggaataaacaaacaattaagcttatattttcttttaaaccaataaatcaattgaacacaaaacaaaacacaaaaaggtctatataaagctgttataacacttaaaggctccgctcttggagacataaaaaatacaggaagcacataaaacaatatatacatatatgaatattttttcttacatctaccggcaaatcgcataattataaatgtacacatataaccaacgatcataactccgaacatattccctaaaagataagattccgcaatcgcactacttcccataccatgtccgtttaaataatatctaggagatactttatacgacaaccagtctgcccaagaatacccttcccgtaccgtacctaaagtttgtccattaggtattcctaatcccaaatactccatcaacctattttctctaaaactatttgttattggcccaacaaaataaagccatccattagcaacttcatccacatattgtatcgtacggcctatcgtttgaatagaagtgccttgttgccaaaaaaaagattgaatcaattgcgtgaaaacaacatcatcctttttttgatctaaatctttaaaaccactatccctaaaatcattaacgagttgagctacatatattaaagaaaatccgatcaacacaaaacgtaacatccatctccaattcactctaatacctctaatacctaaatagacaagaaatgccaatacttgcgtaaatgttgcagatcgaccaccagtacctaacagtatcaacaatgtaaaaatgtaaaaacaactcactaatatatattttttccctatgggaaatgtacttaaatacaagtatattccagccacacaaagatcatcactaattctcaaaataggattatcaacagttgttgatgattcatttaaatacaccgccaaataaccattttcaacaacaaattttacagcttgatataaatacagcaaatatggtacacaaaatgatataaacaagaagaaacccaatcgacgtatttcaaatatcaacgaatcatttttcacgcacattttataattatatctatcaacaaagagacaagaagacaaaaaaccaacaaatgaaaaaagaagataaaatataattgaattcaacatctcaaattgaattgacaatgagaaataagaccaatcattagcccacgtcgagacataaaaataagcatcttcaaatcctagcgcatctaaaaatacacgagacataataaaaacgccaaacgctaaaacataaaacgtatataaaagagaatcaacatccttaacgacaagcaacaagactatacaaaaaagatatatagagcatgaataatatttcaaaaaagacactatcacctcacttggagattgtacccacagaataaactgaagaaatattaagataaaaaacaaaacaattaacccctttatttttttcatatattcaaattctaataaaaacaagtagaatatatttcatcttcctttaaatacatccataatacaatattcagcacctcacgtagaactttcatctaacaatgaggattatatcaaccatctataattgttaaatgacacatccggacaaatcgcatcatcaggtttctcatcccctgagcaacaaaaagcaaggctaaagtatctaaaacagagaatacaagagtggttaataatccagcaaaaaatgtcgtattttctttctccattgaatatctcattccaaggaaaacaatcactccacaaagcaatgttaccaccaaatgcttcgcatacataaacacgtatattctcaatggctcatccaagcccttgcgaaataaatagcaaggtttccaacaaaaaacgactagaaataagctgatcagaaccccggataacacaccatgcaatccaaaggaataccccaagatgatagatagaccaacattaacagacgcttctatcaccggagcccaaatatcgctaaataagccataagcattaatataagtatcgaccgttgttcggcttaaatttataaacagaatagccgtcatcaacaacaagctcaaggaatccataacatattccttgcctatccaaaaggagacaaatgatggagtaaccaaaagaaccccgaagcacatgatacacgagaacaagaatcttatagaaaacagttccgcaaatacactcatgatctttcgcttatccccttcagctatcaaatttccaaccccggcattcacactgttaaacagagccgtcatcaaagtttgaacacccattacaatcaacatataattgccgtacaaagcaactatcgttaatgtcgtataggcatatataataatgggactactctgcgtcaacgcaaatcccgcaatcttatgaaaaaacaactgcttgaccttcgtgagcacatccggatatttcctagccaactctttacctacatacaaatcagtctttaaacaaggataagtccgggcgatcacccgattcaaagccaccgaagccaccacagcgaacaccacttccaataccagccaccaaacatacccattagataaataccggatcgccaatatttggcaaagcagtttcgccaacattgaggctttgtaactatactgtatcttatactcctgctgatccgcagatagcacaatctgcttataattaacaaaatagctcaatagtgcgctaaccaacaacgccccgaaagaggcatacgcataccataacggcaatggcatcttggcgaagatccaagggaaaaaggccatcaggactacactcccggctattacgatccatgcgatacgccgatagagccatccttgcaaggatacgatctcattaattgcgttcgcatctttctcggcaagcggtttataaagggtacaagagatagccgatcccacccccagctctgcgaggttcaagaattgcagcaaattagtagccgtggtattcagccccagcacctccgcccccaagtaatccaagaagagctttcgggaaaagaactggaggatcaagttgatgaaataaaacaccaacgccaccgaactgttttttatgctcttggatgttcgcgaatctgtctttgccatatcttcgacaagcgtatcttttgtcccaagcagtgggagagcactgtcccaaggcatggaacagataactccttccggttgggaatctactgttcccttaccggggaagtctctgttcccttatcaggtaaaccgcctttactagtactggtaatagcgatttagcgcaagcatctaccccctatagccataccccttagccccagtgttcactggagtttgagaaggtaccgaaatatcggattaatttataaattatttgtttttaaacacaacagttcttgtgtcgtaactattcagcatgttgtgtaaaacgttctgaaatctttttcccactcttgcaataacaaaatagattcctctacttacctcaaagcagagattattctttcttttcacaagataaaaattctatttttctctatctcttttctaagggcattttactgtgccctaaaccgggttgtattaaaattttagaggatatgtcaaaactcaattttagcccagatgagcttttgatttgaaacttgaacatccttaaagacaaaaagaagagtcgtaccattactcaaaacagagcttgatacgcctcttttaggtcttgtaaggacaatctgtaatttttcggagaggtcattttagttttgacacatcctcaatccaatgaaatccctagctgagctgccatgtaatttaacctttccaatcacactgtgataagtagcagccatttcagcaccggcatcactaccgtaatgaagtgaattgtttcgttgagtagtaagcttccgaatggttcgcacaacaaggttgctatctatcggtagttccccatcatccaagaaagtaaatatctctttcctaaatcaattcagataattaagggcttctgtataatactgacttctaaattctgaattctttgactgtccactgtccaacaaggtacgcaattcgattaggagtctcttcgtttccgtaagcctgatacctctgaaagataatacatcttacaacgataagatgatacaccttacattaacaagatgatacatcttccgcacgaagataaaacatctttatcagactagagtaacctgtaactctcaacaagacatagaaccctcaataacccaatcccccaacgtatgccgctcactatcaaaattaatcccaacctttacgatcggcaacccacaaagagcgaagcgctccgggtaattgcgcaaattgatttgctcaagggctatatccgcagtcctgtttaacttcaattccacgacatagagtgttgtcggtgtgcgcatcaccatatccacacggcctttcggggtacggacttccacgtccacatacattcctagcaggctgaagatcgtgtaaagcaaggactggtaatggccctcgtaatccgtattgtcacattgggggatggtggacaggaaggtctgcaataaacgcagggcatcgtccatccgctctccagagatcgcctcgaaaagaagggctaccgtagtaagtccatccgctgtgtattgatgcaaataattaggcaataaactcttcatcaatcccatacgtacctccttgtttgggatgtcgagcgtgtacaaattcgtgagcgaggaataatcctttatcgtgatgtaaccgctctgatagagcaatggcgtaatatcgaccatccgttccgtgggtgcgtcaaacgactctgccaaaaccttgcgtgcgcctatttgctggggtttcacgtgatacttgttcagcatctcgatcaaataggtgggcgtaccgctaccgaaccaataggaatttagtttactgtcggccaaggcgttcaacaggctgaacgggttgtatatatcgggcgacggccacgtgaaatggtaaccgtcataattcgatttcaaggcacccaaggcaccctccggagaaacgccgaggttgtcggccaaacgaccgataccctcgcccatctgctcacgcatctcctcctccgtgatgccacagagggcggcgtactccgggagcatgctgatgttctttatattgttcaactcactgaagatgctcaattgggagaacttggtaattccggtcaagaaaacaaaacgcaaataaggatcgcaggctttcagcggactatagaagttacgcatcacgtcgcgaagcttcggcagctctttctcctcatgcaccacgtccagcaagggagcgtcgtactcgtcgatcaagacaaccaccttttgaccggtctgggcgtaggcacgtttgatgagactttccagacgttggttcgtataaatagcgctctcatcacgtccgtatatctgctcgtaaccatacaatttcctctccaactcactcagaagccgatccttgtccatatgctttgccgtgctcatgtcgaaatgaagcaccggatagcttgtccactccttctccagacactcgatagccaaaccctcaaacaaatcctttcgcccctcgaaataactatggagcgtagaagtaagcaacgacttcccgaaacggcggggacggctcaagaatatataaccagacgcgccgtgtgtcattcggtagaccaattccgtcttatctacatacacataattcccctctctcaatttggagaatgtctgtatccctatcggatataatcgccgcccttccatcttcgtctctgtttattggttcgtcaagacaaatataacgttatttccctaaacgatcaattttcaaccctctatttttctattccacgcctcattgccctatacacctccttgagcgccccggccccataccccatgaactccggttcatccatctctacgcatagttcttgtaccaagcgggtcagactctggggattgatactctttttttttcgctttgctgtaggtggcggtgcctacgtgggcctccgcacaaaactcacggatagagattcctaaccgcttacgtggaaattccactaactcatcaaataaaatttggttcaaatctaaattttccttcatactatgctaatttttattaaacaatcatccgatatttcagcctataggctgaaacgcagaatcaattattagcaatagctttagaaaattaatctgaaatcctattgatatggaccaacaaatgtcttactttcttcctcccatcaccaacacgcttcctaccgggaactgtacactacgggaagtgtaccgatggatcaccgaggataaatctctcgaaacggttaccaacgaattacgcgccttcatcagggaaggcagggtagcggaataccgccaactcaaacagcgacaactgccgttcgtaacgccccacggcgttttttcccgtcgtaagagcgacgctctcatctccgcctcggggttggtagtggtcgatatcgaccatctcgcctctctcgaggaggcggaacaactccgggaccacctcttcgaggacccctatctcgggacccgcctcgcctttgtcagccccggaggactgggagtgaaacttttcatacccggagacgagaccgttcgatgggccatgagttacatacagttcctgtatgccgacaccttcaagggtgaggtggatacctgtggcaaggatatcgcccgctgctgtttcttgtctcacgattctaacgctaaaatattcataccatgaacaacgatctttccaaactagtagaagccgtacgggcggcccatgccgacatcgcccccacttacgccgagtatgtacaattggctttcgccatcgccaccgattgcggggaggcaggacgtagcgacttcatcagtctctgcgagccatcgtccaagttcaacgccctacacgccaacaagcttttctccagtgccttgcgcaccggaaaccagaatgtccatctgggcaccgctttccacttggccaagctggcgggcgtggaaataggtttcaagtttcaaggtttcacgaaacccttttcctcacacacacgtgtgagtacatataatacagccgatacggtagatcaagcccacgagaccagcgatcgggaaaccgaggcaaacggcgccccactccacatcggcagcgagccttacacctccctgccacggctggtacccggctatccatggccctcgttgctacgggacatcctcggtttcgccgataatgccgagcagcgggatatccttttgctcacggctctcaccgccctaggcgccaccttgggcaagacggtgcgttgcctctatgggatgcattggatctatccctgtatccagctcttcgtgatcgctccgcccgcatcgggtaagggcatcatggcgtggctgcgtaagtttatcgagcctatccaccgggagatccgccaacaagtggacctagcgatgaaacagtaccgccaagatttggcggcctatcatgccttaggcaaggagaaagccaagatggagatgccccagatgcctaaaaacagtatgtttatcatctccggcaacaacaccgggacgggtatcttgcaaaatatcatcgattcggacggcaccggtatcattttcgagaccgaggcggataccatcaccaccgctatcgggggtgattacgggcattggagcgatacgctccgtaacgctttcgaccatgccgggctctcgttcaaccgacggaccgataacgaataccgggaatgcgattccaccttcctctcgatggtgctctcgggtacgcccggacaggtagcgccgcttatcccctcgggcgagaacgggctcttcagccgtgaggtcttctactacaaatcgcagatccgggaatggatcgaccaattctccgtcgacgaggtagacgccgagaaggaattccaccggatgggctacgagtggaaggccacgatcgatcagctcaagtgccggggtaccattaccttgcgcctcgacgagcggcaacaagccgctttcaacgacagcttcgtacgtcttttcctgcgtgcccggcaatccaacgggcaggagatgaacagttccgtggtacgcctcgccatcaacctcgtacgtttcatggaggtggtagccatgcttcgtgccttggaacaaccggaattactgctgccggcccaaggcatcaacagcgacaacctaaaggacaagatcattggaggctgggaactccatatcaccgacgatgacttcgccgcccttctgacaatggcagagccgctctacctccacgccacccatatcctctcattcctgcctaccggcgagatcaccagccgaggcctctcggaaaaggacagtctgctcagctccatgccagacgagttcaccaccgtccaatggatggagaccgccgagcatgccaacatccccaagaacaccgccaagacatggctacgccgactatgcgactccggagccctcctgcatggcgagcataaagggatttatttgaaacccatataatgtacgtacgtgtgtgtgaggaaagagggttcatgaaaccttgaaacttgaaaccctcctatagtcattttaaaattcaatacagatgaaaaaaatagatctcgcccgtcaatattgcctgacaggcaccccttcgaacgctttgcataagttgaaccgatatatccgtgacgtgaaaggactgaaagaggcccttatccgtcatggttatcattcgaaagaccgctccatcacgccgaagcaagtacagatattctatgattttttaggggaaccctaaaattcttctcctagagcgaataggtggaaacaaatggtatatccgggctttccgcctatcgtatctttgctacagaaacaaaaacatcaaccttgtctcctatgcgctactttaattatcaagagtttgaagactccgccacggcccggcgagacgggatcgacaacagcctcaccccggtggcccagcaaatggtcacgatcctagtggaaatgctgctagacccgctacggcgggtctggggcagacccatcgtcatcagtagcggctatcgctgccccgaattgaacatccttatcgggggagccaagcacagtcaccacctcctcggttgcgccgccgacctgatagccggctctccagatgatcatcgccgcttgttccgactgatacaagagacgcacgagctgtgcggactcgagttcactcagctcattctagagcccggcgcccgatggatccatatctcttacgtacccggcaatcttcgctgtcaggttatcgataaagaaaagtcgcctaattgacttaagtctttcaaactgaagacttaaatcaaggagcacgaaaagccaagtcatcaagcgtgaggactcaactcatcatcccccaagttctttatgtatcacttaaaatatcttacgattatgtcattaaactattccattgccatgatgggcaacccgttgaaaaaagaggaacccaagaaagcctacgccaaggcgcaaaccaacggcgagctcagtctaaaagagctatctaccctgatagcgagtaaatgtacggtgcaccaagccgacgtttcggccgtgctcatcgccaccaccgagtgcatgctggaaggtctgaaagccggtaagcaggtgaatttcggcgatctgggcgccttccgcctccagatcaattccgggggagcgccaagtgccgacctgttcacctccgactatatcaagggggtgaacatccagttcgtccccggcgaggaacttcaagtcatcttccaaggcctcaagttcaacctcgtccccacccgggccgcccaagccgccgtcatcaaggcccagaaggccggtaagacaacagtggatatctccggtaagaacggctcctcggacagcgagagcccggatgagatataagccaatggggcacgtttcggcgtgctcattgatacagacttcgtattatcaaccttataaaacaaatttaaatgagtgaaaagaagaaaaccaacgtttggagcgtaatcatcaaagtagtcatcgccatagccaccaccatcgccggggccttaggcatcagtgcttgcgctttctagcgccttatccaagacctcgtacttagagtgccggcttttgaactcggggacgatcgccttcatcttgcccacgatggccatatcgtccctcgagcggcctaggccgacgagttcatctatatcttggcaaaccgtatcataatcgtactcccgtaccttggcgatcttgatcttcggatggaaggtaggcagcgtgatctcctcgtcgttcagtacctcctcgtacagcttctcgccggcacgaagacccgtaaaccggacctctacgttcttggcgcccgaaagctgaatcatacgtttcgccaagtcgatgatacgcacgggtttgcccatgtcgaagacgaagatctccccaccgttacccatcgtacccgcctccaataccaaccggcaggcctccgggatcagcatgaagaaacggatgatatccggatgcgtcactgtcacgggaccgcccttggcaatctgttcacggaacaatgggatcacggaaccgttagaacccagcacgttgccgaagcgggtcgtaacgaactgcgtcacgccttccacatgcccctccttgatcgctttgtctaggctctgtacgtaaatctcgcagatgcgcttcgagcaacccatcacgttcgtaggattcaccgccttgtccgtggagatcatcacgaatttcctcgtgccatacttcacggccaagtcggcgatcacacgggtaccgtccacgttgttacccacactctcacaaggattatcctccatcatcggaacgtgcttataggccgccgcatggaatacataggcggggcgatgctccgagaagatctcctccatgcgagacttgttagcgatgtccgccaccaaggtataggcgttgatatcccgccaatccctcgccatcatcaagcggatgtcgtgcaagggagtttccgcctgatctaccaagatcaagcgatccggagcgaacgaggcgatctggcgcaccatctcgccaccgatgctgccggcggctcccgttatcaggatgcgttgaccacgaagcaagcggcccaccgcctccatgtctatctctatcttttcccggggaagcagatcctcgatctcaaccttccggagttgtgtatgtgtcaaatcgctcctgccatcccattcttgtgccgccggggtcacgtagatcttgatccccgcctccgccaaacgggccaccatatccggctgttcccgaatggagtcgctcttcaagggggagacgaaaaggatcgtcgcccgctcccggcgcatggcatcgatcagctcctcatcgaaagggtacacacgcactcccatcaatatacgattctgcatgttcccggcctccgagacgaagcctgccagcacgtactgtgcgggatcttggttctggatgctcttcgccaaactgataccgccctgcttcacgccgaagataaaggcacgttcagccttcgactggcgaaaggtcgtcacgtagaaatacttcacgaacacacgcatcgcccacatcaagctcatcgccagcagggaggatagcacaaggtctcgtttacggatatacaccaagtaaggcgaaaaatccgtaaactcttggaaggtcaccacgcaaaccacaccaaacagcacggcaaagcccacccgttgcaaatccacgaaggaagagtaacgaatgatgcccgaatacgtacggaacagcctaaagcccaccagataaggcaccagacaaacaccccatgtgagcgacaggtgccagaagatgcccttcgtggcgaagatcccgttattcaaggcatataccagcaagcctgaaaacaggatcaccaagcaatccaacaggataatactccaatacggcaacgctttccttgagaaataccacgttgagagtttagaaaaaaggttcatcatgaataaaattttgggttcatgtcagctggggcaagccctccacctcaccggcatgccatcttcggtagtcagtcaaggaggattcggggacggtcagcaccacgtaatccgtctcgtcccgcctcaaaatatgtttacgggcgtacgaacgcaacgagcgatccgtcacggacaccatcacgatcgggaacgggtaggcgaacaggcgcagcggcgtgatctcgctatccgggaaggtgagacacaactgataggcagaacgctcgaaagccacccaataaggacccgtacaatataaatggatcgaggtacggttcatgcgctcacgatccatgatctcgttcagatgctcgtttagtaacgtaaccaagcgtatgccagaaggaagagaaggcatgttttgaatttttaattttcaatacccacgtgttttagccagcggtcgtagtcggctaaccgacggatcaaggataatttactcttcttcggggaggattcccgactccacggatcaatcaactcgtgcgcacgataataatagatactgctatccgtacaaccataaagcgtaagtagtaataatgccaacgactgctccgcacggatcaagggtaagaacgagacgatcgttccgatcaacgacttttgccgctcctcgtcccctagtatcgtataggcgggcaacaagagggaatagagcttgcaccgcatcacggcagaatccaactgtaactctccataggcacgcaaggtctcggtcgccagctcacggtctatagccgtaacgccaccatccccccaatgacggcccaacgcctcatgaagaccattttgtatccgggaattgtccaaacgggtatatacatgcttgccttcctcggccaagctgatcacctcatactcgcccggctgaacacgcaataaaggaacccacatccagttgtccacgcataccattacctcccgctcgccaacaccgggctgtattactacacttgcctcaacacctttaaaacgaccatccgtaatgcgtatccggtcacctttacgcaaataacccgcttccggcacatacaccggaagctcatccgagtaagaacgggccacccaacgcaagttttccatctcacgatcggagacaaaaggatatgagccacggccatccacgctaggcaggaaattatacaagggaaaatctcgtttcaaacgaaagatctcatacacagaagagcggataaacacataattgtagagcaacggacggtgagtctccaccaaacgcccctcacggcgatgcatctccacgaaagagggggcgaaaaaatcgaacgtaggctcgcccaaacgcaccctgcgatctaactccttctccaaacccttggctggacctttgtgacaagcgggaagagataatacataccatcttacggtgtggacatcacgcaatggtaaagggggaagatcatgacccatagatacttcaatgccatatcagcgcattctattaacacactgataatctaatatttaaatcaaatattcttttctattcccgaaaattttaaagcaatagaaaccatgtcaatatctcttctatcgggacgtggaagatcgactacttgggaagtagcgtaatagagcactggtctccaaaaccaggtgtcgggagttcgagcctctccttccgtgctaaaatctatagattcgatgaaaaagataattacttatattaaggaatcttataacgaacttgtttataaagtttcttggcctacgagagcagagctttccaatagtgcggttgttgttatgtttgcttcccttatcatcgccgcattgatctttgttgttgacggggccttcgaggctgttatgcgtttcttctacaaccaaattttctaatcagttaaggtatgtctgatatccaaaagaaattttatgttctgcgtgccatcagtggcaaggagaacaaggtacgggaatatctagaggctgagctgaagaatacggatctgggagaatatgtatctcaagtcttgattccgaccgagaaaacctttacggtacgaaacggtaagaaggtcatgaaagaaagagcttacttgccgggttatgtactggttgaggccgctttggtcggtgaggttgctcatcgattgcggaacattccgaacgtgattggtttcttgggtggttctgatacccccgtgccattacgtcctgcggaagtgaatcgtatcttaggtacggttgacgagttgcaggaacaacaagaggatctggatatccagttctatgttggcgagagtgtgaagattacttttggaccgttcagcggtttcacgggtataatcgaagaggtcaacgccgagaaaaagaaacttaaggtgatggttaaggtcttcggacgcaagactccccttgagttgggttatatgcaagttgagaaagaatagtactctggttacgaaaagtgctacctttctgttattgatgttatatatctaaaaaattttagaaacaatggctaaagaagttgctggacaaatcaaattgcagattaaaggaggagcagcaaacccttctcccccagtaggacctgctttgggttctaagggtattaacattatggagttttgcaagcaatttaatgccaagacccaagacaaggctggtaagatattacctgttgtaattacttactatgccgataagtctttcgactttgtcgttaaaactcctcctgtggcaatccagttgttggaagctactaagaagaagagcggttccgctcaacctaaccgtgctaagatcgctgagatcacatgggagcaggtgaaagctatcgctgaagacaaattagtcgatctaaactgctttactgtcgagtcagccatgagaatggttgcgggaacagccagaagtatgggtatcactgttaaagggacattcccgggtaataattaataaacttcaattgagatgagtaaacttacaaagaatcaaaagttggctttgggcaagattgaagctgggaaagcatatacattgaaagaagcttcagctttagtgaaggaaattactacaactaagtttgacgcatccgtagatgttgatgtccgtttaggtgttgacccccgtaaggccaatcaaatggtgagaggcgtggtttcattgcctcacggaactggtaagcaggttagggttctcgcattatgtactccggacaaggaagctgaagctactgccgctggagctgactatgttggattggatgagtatattaataagattaaaggcggttggactgacattgatgttatcatcactatgccttctatcatgggtaagatcggtgctcttggtcgcgtattaggccctcgtggtttgatgcctaacccaaagagtggtacggttaccaatgagatcggaaatgcggtgaaggaggttaagcaaggtaagatcgactttaaggtagataagagcggtatcgttcacacatctgttggtaaggtgtctttcactccggaacagattcgtgacaatgctaaggagtttatttcaactttgatcaagttgaaacctactgcggctaaaggtgcgtatataaagagtatttatctttctagtactatgagtgcgggtattaaaattgaccccaaatcagttgaagaaaactaaaaaacaattgaacaatgagaaaggaagataaaggaactgttataggtcaattaactgaaacattaaaggaatatcctaatttctatttgacggatatcgaggcgttggacgctgagaaaaccagcaaattgagaagagagtgtttcaagcgtgaggttaagttagtcgttgtaaagaataacttgcttaagaaagcgttggagaacattgaaggtgacttctctgatcttaacgtggctttgaaaggcaatacggctgtgatgttctcacaagtcgctaatgctcccgctcgcctgattaaggattttactaaggacgctaaaaaaggtgtagtcgttaaaccggctttgaaggctgcttacgtacaagaaagcttctatgtaggtgctgagaatcttgaggcattagtaaatatcaagagcaaaaacgaacttattgccgatgttatcgcattgttggaatctccggcgaagaacgttatctctgctcttcagtcatcaggacaaactatccatggtctgttgaagactttggaagaaagataatttttcattaaaacattacacagataaataatcatttaaatcatacaaaaatggcagatttgaaagcttttgcagaacaattagtaaacttgaccgttaaagaagttagcgaattagctactatccttaaagaagagtacggtatcgaacctgctgctgcagctgttgctgttgctggtcctgctgctggtggtgctgctgccgctgcagaagagaagacttctttcgatgttgtattgaaagcagcaggtgctaataaattagctatcgttaagttagttaaagaattaacaggtcttggcttgaaagaggctaaggatatggtagatagcgctcctagtgcaatcaaggaaggtatcgctaaagctgatgctgaggcattgaagaaacagttggaagaggctggagctgaagttgagcttaaatagtatttataacctggtttccaggtgatttggttaagagtctccgactacgaagactcttaacctttttgtgtctataatttcaataagttcaataaattccttactagatgtcttcaacagctgaaaaccaaagagttaattttgcttcgataaagaatcagttcccgtatccggactttctcgaagttcaattgaagtcgttccaagactttcttcaacttgacactcctcctgaaaagagaaagaaggagggattgtataaggtatttgccgagaatttcccgattgcggatacccgtaacaattttgtgttggagttcttagattactatatagatccgcctcgttactgtatcgatgagtgtatcgctcgcgggttaacctatagcgtgcctttaaaagcgaagttaaaactgtactgtacggacccggatcatgaggacttcgatacggtgatccaagatgtatacttgggtccgatcccgtatatgacggacagaggtactttcgtgatcaacggcgccgagcgtgttgtcgtgtctcagctgcaccgttctccgggcgtattcttcggacaaagcacgcacgcaaacggaacgaagttgtactccgcacgtattatcccgttcaaggggtcatggatcgagttcgctacggacatcaacaatgtgatgtacgcttacatcgaccgtaaaaagaaattgcctgtaactactcttttgagagctattggttttgaaagcgatagagatattcttgaaatcttcaaccttgcggaagaggtgaaggtaacgaaagcaaacctgaagaagtttatcggacgtaagctggccgctcgtgttttgaagacttgggtggaggatttcgtagatgaggataccggtgaggtggtttctattgaacgtaacgatgttatcatcgaccgtgagtctgtactggatagcgacaatatcgaggctatcttggattcaggcacgcaaaatatcttgttgcatcgtgaggaccagaatctgtctgactatgctatcatatataatacgctccagaaagacccgagtaactccgagaaggaagctgtgttgtatatctacagacagttgagaaatgcggaaccggctgatgaggctagcgcacgcgaggttatcacgaacctgttcttctcagagaaacgttatgatctgggtgaggtgggacgttacaggatcaacaagaagttaggccttactacaagcgctgatgttaaggttttgactaaagaagatattatcgagatcatcaagtacctgatcgagttgatcaactcgaaggctatcgtggatgatatcgaccacttaagcaaccgtcgtgtacgtacggttggcgagcaattgtataaccagttcggtattggtttggctcgtatgtcacgtacagttcgtgaacgtatgaacgttcgcgataatgaggtgtttactccgattgatttgatcaacgcgaagacgatttcttccgtggttaactctttcttcggaacgaatgccttgtctcagttcatggaccagacgaacccgttggcggagatcacgcacaagcgtcgtttatcagccctaggtccgggaggtttgtctagagagcgtgccggattcgaggttcgtgacgttcactatacgcactatggtcgtctttgtccgattgagaccccggaaggtccgaacattggtttgatctcttctttatgtgtatacgctaagatcaacgatctaggtttcatctcgactccgtaccgtaaggtggcagatggaaaggtcgacttctctgaggaaggcttgcaatactacacggcggaggaagaggaagagttgacaatcgctcaaggtaacgctccattggatgataacggtaagtttatccgcgataaggtgaaggctcgtttcgaggctgacttccctgttgtccctccttctgagattgacttgatggacgtggctccgcagcagatcgcttctatcgcagcttcattgatcccgttcttggaacatgatgacgctaaccgtgcgttgatgggatctaacatgatgcgtcaggcggttcctttgttgcgtacggacgctccgatcgttggtaccggtatcgaggcgcaggttgctcgtgactctcgtactcagattatggctgagcgtgagggcgaggttgtgttcgttgatgctacttgtatcaagattaaatatgaccgcacggaggacgaggaattcgttagcttcgaggatgcggttaagacatataatatcccgaaatggcgtaagaccaaccaaagtacgacagtcgatttgaaaccgacctgtcatcgcggacaacgtgtgaaagccggcgatatccttaccgagggttactcaacccagaaaggcgagcttgctttgggacgtaacgtgaaggtggcttacatgccttggaagggttataactatgaggatgctatcgtgttgaacgagcgtatggttcgcgaggacttctttacgtctgttcacgttgacgagtatatccttgaggtacgtgagacaaagcgtggtatggaggaattgacttccgatatccctaacgtcagcgaagaggctaccaaggatttggatgagagaggtattgttcgtgttggtgctcgtatcgagccgggtgatatcttgatcggtaagatcactccgaaaggtgagtctgatccatctccggaggaaaaattgctgcgtgctatctttggtgataaggcgggtgatgtgaaggatgcttccttgaaggctactccgtctttgcgcggtgtggttatcgagaccgctttgttctcgaaggctgtcaagaaacgtaaatccagattgactgataaggcgatcttgccgaagttggacgaggaatacgaagaaaagatggctagcttgaagactttgttagttgataagttgttagtgcttacaaacggcaaggtttctcaaggtgttaaagactatatgaatacggagattatcgctaagggtgctaagtttacccgcaaatctctggaagaattggattataactccatccaagtaagcaagtggacggcagacgctcagaaaaatgagttgatcaagcaggttatcttgaattatttgaagaagtacaaggagcttgacgctgagttgagacgtaagaagttcgacttgacgatcggtgatgagctgccgacaggtatcgtacagatggctaaggtttatatcgccaagaaacgtaagattcaggtaggtgataagatggccggtcgccacggtaacaagggtatcgtatcaaagatcgttcgtcaggaggatatgccgttcttggaagacggtactccggtggatatctgcttgaacccgctgggtgtgccttctcgtatgaacttgggacagatttttgaggccgtgttgggttgggccggacgtgagctggacgttaagttcgctactccgatcttcgatggcgcgactttggatgatttgaacgaatggacagacaaagctggtattcctcgctacggtaagtcttacttgtatgatggtggtactggtgagcgtttcgaccaacctgctacggtgggtgtgacttacttcttgaagttgggccacatggttgacgataagatgcatgcccgttcaatcggtccgtactctttgattacgcaacagccgttaggtggtaaggcacagttcggtggtcagcgtttcggagagatggaggtttgggcactggaagccttcggtgccgctcatgttcttcaggaaattcttacgattaagtctgatgacgttgtaggacgttcgaaggcttatgaggcgatcgtgaagggtgatccgatgccacagccgggtattcctgaatctctgaatgtattattgcacgagttgagaggacttggtttgagtttcactctggattaattcaataacaataaagaagtaggtgggctacggcccgtctactttatctattgataactctttataaataaataatatggcctttagaaaagaaaacaagataaagagtaacttttcaaaaataaccatcggtctggcatcccctgaggagatcctagagaactccagcggtgaggttttgaaaccggaaacaattaactatcgtacgtataagcctgagcgtgacggtttgttctgtgagcgtatctttggtccgatcaaggactatgagtgccattgcggtaagtacaagcgtatccgttacaaaggtattgtctgcgatcgttgtggagtggaagttacggaaaagaaagttcgtcgtgaacgtatgggacacatccatttggtggttcctgttgcccatatttggtatttccgttctttgcctaataaaatcggttacttgctaggtcttcctaccaagaaactggattccatcatctattacgaacgctacgtcgtgatccagccgggttgcgtagacacggtcggtgagttagacctattatctgaggaggaatatctggatattttggatagccttccaagagaaaatcaattgctagaggatacggatccgaataagttcatcgctaagatcggcgctgaggctgtttatgatctgttggctcgcttggacttggattctctttcttatgagttgcgtcaccgtgcgaacacggacacatctcaacagagaaagaacgaggccttgaaacgccttcaggtggttgagtcttttcgtgcgtccagaggtcgtaacaaaccggaatggatgatcatgaaggtgatcccggtgatccctcccgaactgcgtccgttggttccgttggacggtggccgtttcgctacttctgacttgaatgatttatatcgtcgtgttattatccgtaataaccgtttgaaacgattgatcgatattaaggctccggaagtgatcttacgtaatgagaaacgtatgcttcaggaggccgtggactctttgtttgacaactctcgtaaatcgagcgctgttaagacagacgccaatcgtccgttgaagtccttgtccgacagtttgaaaggtaaacaaggtcgtttccgtcagaacttgttgggtaagcgtgttgactactccgctcgttcggttattgtcgtaggtccggaattaaagatgcacgagtgcggtttgccgaagaatatggctgccgagctttataagcctttcgttatccgtaaattgatcgaacgcggtatcgtgaagacggtgaaatccgccaagaagatcgttgaccgtaaggaaccggttgtttgggatattttggagtacgtaatgaagggccacccggtattgttgaaccgtgccccgacattgcaccgtttgggtatccaagcgttccagccgaaattgatcgagggtaaggctatccagttgcacccgttggcatgtacagcattcaacgccgacttcgacggtgaccagatggctgttcacttgccgttaggtaatgaggctgttttggaagctcaaatgttgatgttggcttcacacaatatcttgaaccctgcgaatggtgctcctattaccgtaccttctcaggatatggtgcttggtttgtattatattaccaagttgcgcaagggtacacaaggcgaaggtttgactttctatggtccggaagaggctacgatcgcttacaatgagaagaagttggatatccatgctccgatccatgtttacgtggaggatttggatgcgaacggtaacttggtgaagacgatggttgagacttctgttggacgtttgatggtcaacgagttcgtgccgaaagagattggttatgtaaacgaggtgttgggtaagaagtctcttcgcgacatcatcggtcgggtaatcaaggcttgtggcgtagctcgtaccgctcagttcttggatgatatcaagaacttgggttactatatggcatttaagggtggtctgtctttcaacttggccgatgtgcttattcctgctgaaaaagacgcgttggttcagaagggatatgaggaggttgagcagatcatggctaactataatatgggtttcattaccaacaacgagcgttataaccagattatcgatacttggacacacgttaatagtaacttgtctaatatcttgattaagcaattgacggcggataacgatggattcaactcaatctacatgatgatggattccggtgcccgtggttctaaggagcagattcgtcagttgtccggtatgcgtggtttgatggcgaaaccgcagaagagtggtgcagaaggtggtcagattatcgagaacccgatcctttctaactttaaggaaggtttgtccgtgttggagtactttatctctactcacggtgctcgtaaaggtttggctgataccgctttgaagactgccgacgccggttacttgactcgtcgtttggttgacgtctctcacgacgtgatcgtaaacgaggaagactgtggtacattgcgtggcttggtttgtacggaattgaagaataacgaagaggtgatcgcttccttgtatgagagaatcttaggtcgtgtatctgttcacgatgtgatccatccgattacgggcgaggttatcgttcgttccggtgaggaaatccgtgaggatgccgctaaggcaatccaagactctccgatcgagagcgtcgagattcgttccgtattgacttgtgagtctaagaagggtgtctgcgctaagtgctatggacgtaacttggctacgaaccgcatggttcagaagggtgaggttgtcggtgtaatcgccgcgcagtctatcggtgagccgggtacacagttgacgttgcgtacattccacgtcggtggtatcgcatccaacatcgcaacagagaatagtattacatctaaatatgatggtattttagagatcgatgagcttcgtgctgttgaggcggtagacgaggtgagcggaaagaaacatttggtagtagtaagccgtttggctgaaatgcgcattgttgatccgaacacgaagatcgtgttgttgactcataatataccttatggttctaagttgttcttcaacaacggtgactcaattaagaagggtgacgtgatcatcgagtgggacccgttcaatgccgtaatcgtatcagaggtttccggtaagatcgagttcgagagtttggtagagaacgtaacttacaaggttgagagtgatgagactaccggtttgaaggagaagatcatcatcgagtctaaggataagacgaaggctccggccgctcatatcgtggatgagaatggtaattacttgaagaactactctttgccgttgggcgctcacgtcgtgaaagacaatggtgatgtagtgaaagctggtgaggttttggttaagatccctcgtgccgtaggtaaggccggtgatatcaccggtggtcttcctcgtgtaaccgagttgttcgaggctcgtaacccgtctaaccctgctgtcgtatctgagatcgacggagaggtaggattcggtaagatcaaacgtggtaaccgtgagatcactgtaacgtctaagttgggtgaggttaagaaatatatggttcctctgtctaaacaattattggttcaggaaaacgactatatccgtgcgggtatgccgctatcagacggtgctaccactccttcggatatcttggcgatcaaaggtccgacggctgtgcaggaatatatcgtgaatgaggttcaggatgtataccgtctacagggtgtgaagatcaacgataagcacttcgaggttatcgttcgtcagatgatgcgtaaggtagaggtggttgatccgggagatactcgcttcttggagcagcagattgttgataagttggaggtaatggacgagaacgatcgtatctggggcaagaaagttgttaccgatccgggagattctcagacattgcaggccggacagatcgtgactgcgcgtaagttgagagatgagaatagtatgttgaaacgccgtgaccttaagttggtcgaggtacgtgacgctattccggctacagccaaccagatccttcaaggtatcacacgtgccgctttgcagacgaacagctttatgtccgccgcatctttccaagagacgacgaaagtattgaacgaggctgctatcaacggaaaggtagaccgtttggaaggtttgaaagagaacgttatctgtggtcacttgattcctgccggtaccggtcagcgtgagtttgataagctgatcgtaggcgcaaaggatgagttcgatcgtatcttcgctaatcgcaagaacgtggttgatttcaatgccatggacaaagatgatgaagaataggaacgtttaataaactataaagaaaggccggcagagcaatctgtcggccttttttgttcttccttatttgcttaataaatggataaactttatttttgcgaggtaacaaagaccatagataaatactgagacatataagaaacatataataatcaatatcatgaagagaattttactttgtttaatggtggctttatttgccactggttgcttattcgctaaaaacaacgatgagaaaatgaatgtaatgtcttataacatccgttacgataattcgggtgataaggataatcaatggaaattcagaagagatttcgctgctgatttagtgaaattccatgaggcggatgtgttcggtgcgcaagaggtcttgaataatcagctgaatgatttgcttgatcgtttaccggaatacgcttatgtgggtgttggtcgtgaggatggcaagacgaaaggggagtacactccgattttctatcgtaaggatcgtttctccgttgagaaaagcggtaatttctggttagccgaagatataaatgccgttggtaagaaaggttgggacgccgcatgcgagcgtgttgctacttgggcgatcttgaaagataagaatacgggaaagaaattctttttcttgaatacgcacttggatcatatggggaaagtggctcgtcatgaaggagcttctttggtgctggagcaagcgaagaaattatccgagaatttgcctataatcgtgactggcgatttcaatgccgtgccttctgatgagccgatacaagtattgactaatccgagtgatcctcgtcatttgactcattcccgcacgatcgcagggtttacttacggcccggaatggacattccatgattttggaaagatcccttacgacaagcgtgaatggattgattatatcttcgtgaaagggaatatcaaggtattgcgtcatggtgtattgactgaaacgttgaataacctgttcccatccgaccattgcccggtaatcagtacgttgatactcgaataaaaaagctttgtgtgtatggggaaagtagacgtattgaaggaaactaccccgctttcatcagaagattgcttcttggtcatgcaacgcccgaaatcggggtttaattttccgttacatgtacacatggagtttgagttgaactatctggagaatgccgctggtgctatccggatagttggcgattcggtcgaggaaatcgatgatctggatttggtgttgatcgcgggaggaacgaagcatgcttactcgaaccataagtgtccgtgtaatgggatctttgagataacgatacaatttcataaatcgttatttgatagcttaatcaatagacggcatttcaagaccatgaaggatatgtttgataacgcttccagtggtcttgttttcagccgggaaatgatacttggcattcaagataaattaagaatgttgtcgaacgataacaagccggattctttcaagaacctgttgcgtttggtcgagattcttaagattctatctttggataaagcagcccgtcggttgaatgccgtgaacacggtaaagaactataataataacgataccgatcgtttagatagtatcatgttatatttacacgaaaattatcaaaaacgtatcaccttgtcggaagtggctaagttaacaaatatgagcgatgcctcattgatgcgtttcttgaagaagtggacgggaaagacatttatcgataacttgaacgagatccgggtagccgaggcggtatgccgtttgaccgatacaagtgacagtatttctgaaatatgttacaggtgcggttttaataatctatcgaatttcaaccgggtattcaaacggcgtagggggagtacccctacagagtacagggaaaaatattcccgttcgaggtttataatttaaaacatgatttaaagcatgtttacattgatttgtgtcaagtgttgatgatatagtattatttattgcacatatagtatttggtggtctttgctaaagcccttacttttgtaaagttcaagtgaaagagattagcacttagacaaaacaaaccttaactaaaacgccaaaaccaattatatcaaacacaaaaggtatttttacattggtctaaagaattgagaattaaaaacacaactagaaaacgactgcctgagaaggtagtcgtttttgcatttatagtcttcaacccctttgtaacccggaataaatatgtatatttgtcttcgcaatttttaatcaccataaatttaaaagaagaaagtatggaaaacaacaaacctgccaataacgagattcagatcgagttatctgaagagatggcacaaggaacttacgccaatttggctattatatctcattcaagctctgaatttatcctagatttcatccgggtggttccgggagctcctaaggcacaagtgaaaagtcgcgtaatcttaactccggataacgctcaacgtttgttattcgctttgcaagacaatatcaagaaatttggggagcaacttcaagcaggaaataataataacaaaacagctaattttgaggacttcgcaggtccgacaggagaggcttaatagatttgttttcagccatagaaagagtacttttctacaagagtaggggagtactcttttattgttgggatggctcgtttacattgaaaaaccttgatgcctattcttagatgcttacaatgggcattcttaggtgttaagaatgcctgttataaacacctaagaatgcccatcgtaaagaataccctatctctctatcctaaagattagataatcccatcaatattttcttcaatacggtttgtgcggagatctcacggtttgccgcctcggggattacgatactttgcgggctctctatcacatcatcggtaacgatcatattgcggcgaaccggcaagcaatgcatgaaataagcgttattcgtaagcgccattttctctgcgtctacggtccagctacgatctgtgctgattacttgtccgtaattcggatctttataagcggaccagttctttgcgtaaatgaaatccgctccttcaaaagccttcttctgatcgtattccactttagcgttgcctacgaatctaggatcaagctcataaccttccggatgagtgataacaaactcataatctgtagcgttcatccattcggcaaagctgtttggtacggcttgcggcaatgatttcggatgaggagcccaagtcatgactaccttcggacgagctgttttcttatattcctctatcgtgatcaagtcggcgaaactttgcaacggatggcgtgtcgccgcttccatgctaaataccggccggccggaatgctcgatgaactgactcaatatcttttcgttataatcatcttctttattctcaaagcgtgcgaaagaacggaccccgatcacatcgcagtaacagcccattacaggaacagcttccagcaaatgctccggtttatcaccatccatgataacacctcgctctgtttccagcttccatgcaccttggttaacgtccaaaacgatcgtgttcatacctaagttcatggcagccttttgggtgcttaagcgggtacgtaggcttgagttgaaaaatatcatcaacaacgtcttgttttttcccagttcactaaactggaaacgatctttcttgatctcgaaagcttcattaagcgcttgtttcaagtcacctaaatcctgtacgcaagtgaaatgtctcatatctgttacaataatattttgttaaaggcaaagataatgactacttgtcaattatcctttagaaagaccaaggaattgtttaagagatcgtatccggaggtgttatgggtagtttgaaactgaaggtagaacctttcccttcctccgagttcacccaaatggtacctcccatggcggtgaccagacctttacagattgaaagtcccaatccggtacccggttcaaattcgttcaattgcaggaatcgctcgaagatgtgccctagtttgtccttcgggatgccgttgcctgtatcggacacgtaaaattgcacgctgaccggatacaacgattggtatccgaaatgaatttctcctttctccgtatatcggagggcgttagaaagtagttttttcaagataagcataagcttatgtttatccgtgtgaagagatacgtttggagaatcatccaagattaaccgtacgttttcggatatgcggggagaggcgtattcgtatacatcgtgcatgatagcgagcggatttacatcctcatatgaccaattgatcgtattggactcgattctggacatctcgagtgtgtcattgattaattcgagcaaagccgtgttattttctttaatcatggaaatatactgttcacgcatttccggatcatcttccagtcctaacatatcggagaagccgacgatggcatttaacggagtccggatctcgtgcgtcatatttgccagaaacgtagatttcaatagggaaagatccttggatttctgatgattcgcgatagctagctcgtcgttttccttttcgataatgctacctataatgacatgtggggtgccgctttcatcaatatccatgcttttacccgatatttcatacatcttataagtcccgtcttgattcttcaggtggaaggtgacgttgtgagacgataatttctcgtcccggattttattgaacagatagaagaaatccaaactatcctctggcttacgtacggatgataaagccctgcatataaacctgtttttatctaatagagtattggtcgtgccgtagaattgaaaacagcggttacaatgctttttgtcgcaagtggagaaacggtcgaagctgaatgagtaagcggctaatttaccgtcttccaacgcttgccgcatcaatatccggctctcgttcaattgtcccatcaatagtttattttccctgtcagtttctttttctccctgctgcgtaagccaaagcgtatacccgctaagcccctgttcatcggtatagatgggttctactttaaacgtgacgggctcttcgcatataattgcgtcaccttttcttaaagatgacttcaaggaatcggttagtacgatgttattaaatagatgttctataataaagtcatgcttatctgccaaggaaaaatgagcgaacatcgccttattcaagtctatcagatttccttccgtatcatagatagcccctcctaaaggacaggaatagaatgtatttgaaactaaagtattgaaaatatttgaatctattactgttgacattattcgtttagatttaagtgttgttctagaagaaagagacaggcgagttcctatattctcgtctgcccgtctccttctatgatgtatttataagtcgttaattcaggaagcgccatcggtccccgggcatgtagcttttgggtactgattccgatctccgccccgaatccgaattgggccccatcagtaaaggcggtagatacatttgcgtatacgcaagcggcatctaccaattgctggaagcgccggatagtttccggatcttcgctgattatgctttcgctatgttttgaactgtaccgggcgatatgtgatagagcctcgtctaaagaggatacggtacggatactcattttgtaatcgaggaactcggtaccgaaactgttttcgttagcctgttgtaaaagcgtctccggataatgttcggatagagcggcataagccggttcgtccgcataaatgattacgttgctgtccggaagctttccacagatatacggaagatcagatagacgttctcggtggatgattaagcaatccaaggcattacatacgctgaccctccgtgtctttgcgttatttacgatctcacgtcccttgcctttatctccggagcgatcaaaataggtatgacagataccagcgccagtctcgatcaccggaactttcgcgtgttcccggacgaagtgaatcaaggaactgcttccacgaggaatgattaagtcaaccaagccgaccgctcccagtaattccgccgtagcctctcgatccggaggtagtaaagtgcataccgccggatttataccctgacgctctaatacagaatggatgatgcgtaccaaggctcggttagagaagtccgcatccgatccaccctttagcacgcaaacattaccgcttcggaaacataaggaaaaaacatcgaaggtaacattcggacgagcctcatagatcacaccgatcaccccgaaaggcacggttacttttcggataaccattccgttcgggcgggtagtctcgctcaagaccttatttaatggagaaggtaatgtcgatacattctccatatcggcggcgataccttgtagcctttcctctgtcaatttcagccggtcgtatttcgggttcgctgggtccatacgttccagatcttggcgattcgcggcgagtacctcctccgtatgagtccgtagaacctgcgctgtctcctttaagatcccgataatcgtttgatccgatagcgttatcaattgtttagccgcatccgatgcctgtcgcagcatatcttttacattcatactttttaatccaaatatagataatcataatgtataagcggttttaaatcccgttgccctatttgcttacgtgcttcctcgctgtcataggcggtacagcctacgccgatttgcacgccttcctcattcattatctttacgatatcatctttttcgaaatcaccctcgatgcgggttactccaaccaataatacgctagtcgctttcggggcggtcaatgcctcctcggctcctttattgatatgtatttcccctttggcgaaaccctcggagtgggcgatccatttctttacgctgctgacgggtttcgaggccggaatgaaacgggtgcagaccgtgtcgctatccaccgccaataacatcggaaggatattatcctttttgccgttggcgatgataaccgcaataccttcgtctgccactttttgggcgatatgacatttcgtcaacatacctccccgtccaaaggatgatttgctagtctgtacatattccgacaaatctgttttcccacattcgatttcccggatcacggaactatccgggtccgacggatttccattgtaaatcccgtctatattactaagaatcaccaaggcatccattcccatcatcgtagcgatcaagccggataactcatcattatccgtgaacatcagctcggttacggatatcgtatcattctcattcacgatggggatcaccttgttttcaagcattacctccatgcaatgcttctggtttaggtaatgcgtacgactcccgaaattctcttttgtagtaagcacttgcccgcaagtcatgccatgctcccggaataactcgtaataccggttgatcaacttggcctgtcctaccgccgaatacagttgccgggctgatacgggatccagctttttgccggcctttatctcgcttcgtccggaagccacggcaccggaggagatcaagacgatctccataccttgccgatgcaagtccgctacttggtcaaccaacgcggacatgcgggtgatatctagcgtcccatccttgcgggtcaggacattacttcctatttttacagcgatccttttcaagaaagttatgatttattatttattatctttatcccggatctctacccgtcggatctttccgctgattgttttcggcagttcgtccacgaattcgacaacacggggatatttgtaaggagcggtgacacgtttcacgtgattttgcaattctttgatcaaggcatcacccgctttatccttataatccttcgccaatacgatcgtggcctttactacctgtccgcggatctcgtcggggacaccggtgatagcacattccactaccgccgggtgggtcatcaaggcactttccacctcgaacggcccgatacgatagccggaactcttgatcacgtcgtccgcgcggccaacgaaccataagtaaccatcctcgtcacgccaagccacgtctcccgtgtaatacaggccatcgtgccaagcttcccgggtacgttctgcgtcccggtaatattccttgaataacccgataggcttgccatttgttgtgtggatcacgatctgtccttgctcgccatcctccgcacggcttccgtccggacgcaataaatcgacatcgtactgcgggttgggaacacccatagagcccggtttcggctccatccacgggaaagtggcgactgtcagagtagtctctgtctggccgaagccttccatcaatttaatgccggtcagtttatagaacatatcgaatacggcaggattcaaagcctcgccggcgatcgtacaatattgtaaggatgataaatcgtatttagtcatatcctcacgaattaagaaacggaagatcgtaggaggagcgcaaagcgaggtgatccggtaatcctgtatcatctgcaacatatcagcaggcgtgaatttctcgtggtcgtaaacaaatacggtcgctccggcgatccattgcccatatagcttaccccaaaccgccttgccccagcctgtatctgcgatcgtcaggtgaaggctgtctttatgcaagttgtgccagaaactaccagtcacgatatgccccagcggatacgtaaagtcgtgggccaccatcttggggtttccagtcgtaccggaggtgaaatacatcaaagagatatcgtcattgctatttgggtgagacgggcggacgaaaggagcggcgttttggataccctgttggaaatcctcgaaaccttccggtatttccggccctacggatacgacactttttacggtcggtgagtccggcaaagcctctatgatatgtttcgttatcactttctctccggcgcaaacgatcatcttgatatcggcggcattcgcacgataaacgatatctttcttggtcagtaagtgtgtagccggtatcacgacagcccctaatttatgcaatgcgatgatagagaaccagaattcataacggcgtttgagtatcagcatcaccatatcgccgtgtccgatccccaaggattggaaataagaagctgtctggtccgtataccgtttcaagtcggcaaacgtaaaatcaatatgctctccatgatcgtttgtccaacataacgctttcttatccggttcttcctctgcccaagcgtctaccacatcatatccgaagttgaagttctccggaaccttgatcttgaagtttttaataaaatcctcttgcgactcaaacgtcgttttatctataaatctttctaacatgctgttgatcgtttataaaatgacggccaaaaaactgaccttttccccatccagcgctttcataccgtgaggaagctctgagttaaaataaatactatcaccttcttctaagataagatctttattgttgatctgtagtaacagacgtccttttaataccatattgtattcttgccccggatgggaattgagatacatcggctcatcctctggtttgggatgtacggttaccaagaaggggtccgctttacgtccgacgaaaccggcggccaatgattggtacttataggctttcgtacgctctacggcaacaccttttccgttacgagtaataaagtacgtactcattttaggctcgtcgccaaacatcaacgtggttaattctacgccataagcctgtgagatctggtgcaatacgctaacggaaatatcaaccgtgccgctttccagcagcaaatattgctcagtcgtgaggttgcagacctttgccatttcttccggcgtaatctccagtgcgtcccgtaatccggccagacgctccgcgatttgttgtatctgttcgttcattttgctgaagttattgtattatgtcgctccaaagataggaataaaaagcaaaaagaaggtgaaagcccttgttttcttttctaattaacaggtatggcttgtttttaatacaaatgacgcagataatacggataagaatagcaaatccgtgtcatctgcgtctgaaagataagcatctaatacttattcagcatttttcttcagccattctaaccggcgctgatccgggaggtgttttaccttgaaatgctcgaatgtcacattaaatcctttcccgtcgggacaagcggccataaacccgacttgtacggggatattgtcttgtagccaagcgttacgcataagggtgtattccttatcatcgaatgagtagaagatctccacggcgtccaatctccggactgcttttatccatacataagggatcgctttgtctaaggtgataacgctccagtcggaggtcttatgcgtaacgaccgcgcttaggttgtatttaccatccacgaactctataccggcttttatataattttcatgattgatacgaagcatcaggccggcttggtcaaaacgctgcttgtaatcgccggttatcttgactttcacttcgaattcacccccataagtagcataataaaaaggagcgtcatctaccgtaaacccgtaatgggaaatcctccaatagtcactttggggagtgacctgcatggaaagcgacttgtctttaatctcccattgctccggctcgttgaaccattgcatcttatccaatgattgcgccccgcaaaattgcaaagaggcgacaataacaaaactcagtaacactaattttctcattttacttcttatttcttatttcttatttcttatttcgattctttctattcccgtaagaggttaatgttattaaccttacctctggcaaaggtaacgtgttattatagattgcgcaatgattctgagattttatctaggaaggaaaagtaagggttaatgtgtttttgtctattcgtatttgataacctcgaccggacagctttcggcagcctctttaatacccgcctcgaaatcatcgaaattaactccttcgtttacacgtgagcgatctgtaactgtgaatacttccgggcaaatgccctcgcatgtaccgcaagcgatgcaatcctcctcaatccaaactcttttaattgccataattttattcctttaagatgattaatatgttaatgtaacaaacaactttcgcggattgttttcgggagaggccttttagatcattgtatagaccgtggaatgagcttatctttggttgatatatattaacgtttatacgccactgttttaaaataaatttgctacgtttacagcagaaagtttcattgaataaccatttaaaaaatctgaagtattatggataatgctatttttagatttcctaaacccattaatgagccggtaaaagcgtatgctcccggatcaagtgaaaaagcatccttaaagaaagcgttagcgcagataagttccgaggaatgggatattcctctggtaattggcggaaaagagatccgtacgggtaataccggtaaggtcgttatgcctcatgatcatcatcatgtattggctacttatcataaggcgggcgagaaagaagtacaaatggctatcgacgccgccatgaaagcgcataaggaatggtcagaacttccatgggtggaacgtgcgtctattatgcttcgtgtagctgagttgttggctacgaaatatcgttatatcctgaacgcttcggttatgttgggacagagcaagaatccgttccaagcggagatcgacgctccctgcgaattgatcgatttcttgcgtttcagtaccttctacgctagtcaagtatatgccgatcaaccctattccgagacgggtatattgaatcgtatggaataccgagccttggaaggtttcgtgttctcgctcacgccgtttaactttacgtcgatcgcttccaacctgaatatggctccggctatgatgggtaacgtggcggtatggaaaccgtctactacggcgatccattcgaactatttcttgatgaaggttttccaagaggccggtttgcccgatggcgtagtgaatttcatcccgggacagggtagcgtgatcggtaaggtgattacgggtagccgtgatttggcaggattccattttacaggctctacctctacgttcaataccttatggcgtcagatcggagagaacttggggcattataaatcttatccaaaaatcgtaggcgagacaggtggcaagaactttatcttcgctcatccttccgctccggcgttggatgtggctaccgctatcgtacgcggtgcgttcgagtatcaagggcagaagtgctcggcgggttctcgggcctatatcccggcttctctctggaaagaggtgaaagattacgtgggcgatatgctgaaagagatcaagatgggtgacgtgcaggatttcacgaactttgtcaatgccgtgatcgatgaggcttcgttcgataacatcatgagttatatcgattatgcgaaacagtctccggacgcggaggttctttttggtggtaacggggacaaatcggttggttatttcgtggagccaacggttatccagaccacggacccgatgttcaagagcatggtagaggaaatcttcgggccggtgattacgatctacgtatatgacgacgctaaatatgaggagactttggaactttgtgatcgaacttctccgtacggattgacgggttctattttcgcccgtgatcgctatgcgattgataaggcattcaataccttgcgctattcggccggtaatttctatatcaatgataaaccgaccggcgccgtgatcgcccagcaaccgttcggcggttcccgtgcgtctggaacgaatgacaaggccggtggcccgttgaacttgattcgttggacgaatcctcgttgtatcaaggaatgcttggttcctccgacgagctacgggtatccgttcttaggtgagaaataattgtcataattaagaaataccaactgattgtgggggagacggggcgtgccccgtctctacgctatgacgttacctttatctacatacaatatgttagactttaacaataccgagatcgctttctcgtcgaagtcgcggggagaactacaaaatgcttactggctttttaatacgataaaatatccttggttggtaaaatgcgctaaagtagccacgagtatagccttgaaaatacatttcccgctggcttgggcggtgaagcctaccttatataaacagttcgttgggggagaaactttacaagactgttccgctgccatcaaccacttgatgaaatacaacgtgaaatcgacgctcgattattcggcggagagcgagcagaccccggagggcatacaggcgactttcgaggaaaccttgcgctcgatagattttgcgaaaggaaatacgaatctggcctatgccgtattcaaaccatccacgatcacgaccgatgagttactggccaaagcttccgagaaacgggaagagcttacgatagacgatgtccggcattttcgcgagttccgcgagcgttttatggcgctttgccaacgggcttacgataacgacgtacgtattttagtggatgcggaggattattgtttccaagatgccattgatgcgttgaccgatgaggcgatgcgtaagttcaacaagaaacgtgcgatcgtattcgctaccttgcaaatgtatcgtcatgaccggatgccttatctgcgtcgtatctacgatgacgccgtggcgaaaggttatattgcgggcgtgaaattcgtgcgcggggcttatatggaagcggagcgtgcccgtgcggcggcgttggattatcccgatccgatttgtaaagataagcaggccacggacgagaattatgatgcggcggtccgtttcaccatggatcatttagatcgttttgagatgtttatgggaactcataatgaggagagtaattataagttggcgaaattgatggacgagaaggggatcgcccgcgatgactcccgtgttttctttgcgcagctattgggaatgagcgataatatttccttcaatttagcccatgcgggatataacgtaaccaaatacgtaccgtacgcctcggtaagggatgtactgccgtatttgatccggcgtgcggaagagaatacttctgttgcggggcagaccagccgggaactccggatgttggagatggaaatggctaggcggaaagaacataaacccgccgagggcaggtaaagtagtttgtcagcatatttcggggcgtattggtgctggcaaactactttgtctgcctatttttatttactggccttcagtccccggatcacggaagaggtaaaaccggaaagttccatctcatttagacccttgatcgtgattccgcccggagtcgttaccttatcgatttccatctccgggttacttttattctcgatcaataaatcaacggcacctttcacggtatgcgccacgatctcttgcgcctgtttcggatagaaacccaattccacgccgccttctatcgccgcacggatataacgcaaggcgaaagcaatgccactggaggccaatgccgttcctgcggccatcaaccgctcttctaccagcatggcgttacccagctcgttgaaaatccggatgattaggtccgtctgctccttggaggcattgcgggcggagacgaaagtcatgctgctcatcacctcgatagccgtattgggcatgatccggaagatggtgggagtagccagacaatcgaagtccgtattcttggtcaaataagtattcaacaggtcgaaagtcacgccagccgctacggatacgatcatttgtctctcgaagtcgagcaccgacttaatctcatctataatcatttccacacgccaaggtttaacggcgatgatgatgatatcagcgtttcgtgccgcttccacgttatcatgggtcaagataaagtccggatcgatctttctcatcttctccaaggtctcgtccgattgggcggtacaagtgatatcagaggctttgaacatggttcctttcgctaaacctcgggcgatcgctccaccgatattacccgaaccgataatagatattctcattttgcagataattagttatattattatgttttctgaagaggcaaacttagataaaatatctcaaatacgtacgactttgtagagttagctacggataaaaaacttacatttgcggtcgatacggacttaatactaatataaatatataaaattacatgaaaaagacaattctagtttcaagcatgctattcgctctggctatgtccgctacgatccaagcgcaagacacggagaagaaggagagtgaggagggattcgtgttcacgaccgtgaaagagaaccccattacatctgttaagaaccaaaatcgtgcgggtacgtgctggtgctactcctcgtactctttcttggagtcggagttgcttcgtatgggaaagggcgagtatgacttatccgagatgtttacggtatataacacctatctggatcgtgccgacgctgctgtgcgtacgcatggggatgtttcgttctcgcaaggtggatctttctatgatgcgctttatggaatggaaacattcggcttggttccggaagaggagatgcgcccgggcgtgatgtattccgatacgttgagtaaccataccgagctttccgccttgacggacgctatggtggccgctatcgccaagggaaagttacgcaaattgcagtctgatgagaataacgccatgttatggaagaaggcggtcgctgcggtacatcagatctacttgggggttcctcctgagaaattcacgtataaagggaaggaatatacaccgaaatctttcttcgagtctacaggtttgaaggcttcggattatgtctcattgacttcttatacgcatcatccgttctatacccagttcccgctagagattcaggataactggcgtcacggtatgtcgtataacttgccgctggatgagtttatggaggtctttgataatgcgattaatacgggttatacgatcgcttggggttccgatgtgagcgaatctggttttactcgtgacggagtggccgttatgcctgatgatgagaaggtacaggagttgagcggttccgatatggctcattggttgaaattgaaaccggaggaaaagaagctgaacacaaaaccgcaacctcagaaatggtgtacgcaagcagagcgccagttggcttatgataattatgagacgaccgacgaccatggtatgcagatctacggtatcgccaaagatcaagaaggtaacgagtattatatggtgaagaactcgtggggaaccaacaacaagtataacggtatttggtatgcttccaaagcatttgtccgttataagaccatgaatatcgtggttcataaagatgccctgcctaaagcgatcaaagccaagttaggtatcaaataatcggtccgctaaggatggtttaaataaaaactaaaccccgatagcttccggcgatccggtaagactatcggggtgatctatatatacaaagatgtgctgcctatattattgaacaagttttagtgtgtagttaagatctgccgccgctttttgcaacgcgtcgttcatcaaggtcaagttatccccttctactaggaaataaatgacgggttcgccatcactaggaatcaactcgtagattactgcgctaacgtcatcgggagctccgtgctttactttttgtttaccggttgtaatggctttctgaggagctttcttcgccgctccggtgcttgaggctactgcttccggtacggtataaagagcatccaactcgaatacgccttcctcgtctgcgttatcttgttgataatacaaggttaagtcataatctacattcacgctatccggagaagtcagggttcccttatactttttttggataaccggtccctttttaggatcagccttcaaggaatctctcatattcacgggttttgccggttgagtcgccttaacagaatggatcagtggcagagacggagcgtccggagccgccgacattatggcgaattcttcttcctctacttctacgggaacatccttttgggcttgtttcccgctacatgcggccaaaaatgccatagccgctactgcgataaaatactttttcattaccattatttattttattagtgacgtttggacatataacataaaatcccccacgatttgtttcgtgagggatcatttttaactatttaccgtgaaatatttatttctttgaaggctctaccctgtcatccggatagggagaggccgggatcgtggaagcgcttccgtctcgtccggcgaaatagtgcggtgacatgatctctacgccagcctcattgaatacgtcctgtatgttttgatgcaggtcggaatagatatccccgagtttatcggcgtcctttatataagcgttgatttgataacagggatagtaatcgcttagttcggtctccaatacgaaaggcttcggctctggcaataccccggtggtctggcgggcggcattgatcaataattgatgaacttgccgccaaggtacgtcgtagccgatcgtaaccgtgctgtggatgattaatccgtattgccgtgcggatacgctataatttgttgtatgggaggacatgataaaggagttcgggatggtcactacctcattcttaggggtacgtaaacgggtgacaaacggagtcttctcgatcacgttgccagtcgtctcgtttagttggatacggtcacccaatttaaagggcctcatataagtaatgaccagccctgcgatgatatttccgatcaccgtactggaacccaacgatatgatcaaaccgacaaatacggatatgccttgaaatacccccgagtccgatcccggcagataaggatagatcatggcgatcataaaggcgtatagcaggaaacggatgatattaaacgtcggttgcgcccaatccgggtaaaaacctgatattttcaggttctcgctctctatctcgttggctatgtattggattccttttacgatgtatttgatacagtaatagatcaccaagatgataaacaagttcggaatataggaagctaccgatttaaagatcatctttaccggctccaacaagtaggagaatatcttcaaggctagatcttctgtttgcgggaagatagcgaaaaggatcggtacactgatggttaattggattagtaacacgatccatcgtattacgttggtgaaaaacatcaatacgcgtccttggcgatgtgtgttgagaaattcataatcccggatggtaatagatctgagtcggttctgctttaaccagataattttcctgcgtagtttcttaaacagatggttggtcagcttaaacaggaaatattggatgataattacgaggatgaacaataatacccgtttcgctatctgcaagatactatgttgctcccttagctcttgtatcttgttttggataatcggttgatattgttctgcgagggctatacgactgagattttgccatagggcatcttgatcggtgatacttaggataaccttatctccgtacatgatatccgttacgtattcgctgtcatagatatagatggaatccttcttcaaggaatgcgaggtcccgatctttaccatgatattgaggatgtcctcagcccggtcaaccggggtgcggcctccgcgcttggcgtataggtgaaataaggtatccccctccacgactacaggtacgccgggagtcagtgcccgaagggaatcgatacggtttcgttgctcggccatttttagggagtcggcggtagcattgctgttcttcgtgctttccagctcgtctttgagcaaaatctcgtttagtttcatctcttgcagctggagggctagctcctgcattttgatggaatccttccggtgctgctcgtcgagcgaaaacgtatcggtcgaggtaactggctccttcggctcattgcctaatgtcgtagacaatagttcttcggccttttcccttaattgggcgttggataccgttggcaggaaactgattcctgccaagatcactaatcgcaataaaaattgtttcatcgaatcgtggattaactatttaccaccggccggaagatgctccagccagtatttagccattgtcttacgtaggtgaagagtcgttccttccctttcgttgatgctatggctacgcatcgggtaactgatttgcgtaaacatctttccgttcttgatcaacttgttcaccagcatctcgcaattctggtaatgcacgttgtcatctcccgtaccgtggataagcagcagattaccttccagtccctcggcataggtaatcggggaacctttgcggtagccttccggattgttctgcggagtattcatgtaacgttcttggtagatcgtgtcgtataggcgctggtcagcgacaaaagcgatcgctataccggtatggaatactttcggataacggaacatgcagttcaaggtttgactgccgccgccgctccatccggtaatgccgatccggctggcatcgataaacggatattgacgggccatatctaaaatacctctgctttgatcctcggaggagaaagtgcccacttccccgtaaatacatttacgccattcacgcccacgaggagtattcgcgccccggttctctatactcaccacgatatagccttggttcgccatatattgttgccataaatctccgttaccccatacatcttgtacggtggcgctcgccggctcgccgtatacctctatgataaccgggtatttcttggatgcgtcgaaatcgacaggttttatcatccatgcgtccaaggttagattgccggacttgaccttgataaattctttcgggtttaatcctaaggcggcgtattgatccttggcttgggcattatcctcaagcatgcgtacggattgatgtttcgggaaagaaaccatgtcgataacggatggggtagaggcgttactatacgtatgtatggcccatttgccggtgggtgacatgttgtagcggtgctgtccggattgttccatggggcttacacgctccacttctccattgccgaatgctttagcccggtacaagtagcgttgggtgaaattgtccggggaggctatgaaatagacccagcccttttgtagatcggtcccgaccggcgagatataatcaaaatcacctttggtgatgggttgtatctcttttccgtcacggcttatccggtataaatgccgccagccactacgctcgctttcccatgtgaaatagcggttgtcctttaaccattgtatgttatcattcgtgtctagccatgcggcatccgtatcggtgaagatattattcagcgagttatcggatatcttggcgatccataccttatttgtattctgcgggcggtttagttgctgtatgaacaactcgtcgctttcggggatgaattccatacggggcaggtagttgttccggggatctccgggtatggcgatccaagtggtgttcccgccggtagaggaaacgtagcctacttttacggctgaattggtggttcctgccttggggtatgggaaatggattacctttgcgtagatggagtctacattattaataatgtcaaacactcccgttcctttcgtatcgctttgccaataggcgatatgctttccgtccgggctccagcggaaaccatcccggcaactgaactcctcctcatatacccaatcgaaggttccgttgacaatcgtatcgcttccgtcttttgttagctgcgtgattttcccggagtctatatcttctacatatatattattgttggaaacataggccacacgtgtgccatccggagagaatttagcgaacatcatggaggattccggcattccttttcccaattgacgtaaagcgccgtcctttaggtttaatacccaatagtcaccccgtgtatcataacgccatacccgtcgggtattgttataaatcaagactttctcattatccgcactccaagagacgctacgtacggggataggccttccggtagatttgtccgtcaatagggatgaggggataatgacttcacgggagttatctttcgctcgataggcgacgatatccgtgcctccggtttgcttattattttccaagcggctataacgttcaccgtcttttagccaagtcatgcttccgatgccttttgtttgtatgatgttaccggcaactatatcctcaagattcaacgctttttgtgccatgcttatacctcccgacagaaggctgatcgtggcgatcgctattaatttgtttagtttcatgttgtattagttggttactactatatttatgcaaagaacggaaagttagttgatataacaaaatggatttgtatattcgcgcctcggaaatcaagaataatcataatttaattttatatagaaatcggaatgaaagcactttcaatgtatgtatggtcacttttagtgatcatgatgatgggatttacttcttgtggggatgatgatgagcttcaattctcggaagagcaattggcttatatcaacaaaaacaaggaatacatctgggagaagaaagcggagaaagacgagaacggtgaattgaaatataagcaagttgttataggaggtgatactgccttatatcggatcattcagaaagaaaatgagtggacaacgacaccttccgcaacctcagtggtttatttgcttgatctggaaggaaaatatattgacgggaaagtctttcaaaagaaactggatagatcaagtttttctatgaacggcattatcccgggcttaagcggtgtcttattgaatatccatctggatgagaccgtggaggcgattatcccggcttcgctaggttatggatatggagattatagcggtatccccggaggttctactttaatctttacttttaccttggataaggtagaatgaataataccttgatggataagcctatcttctatatccgtctccgctgaatgttcgttcgccgccgctgaatgtatattcgtcgccgccgaacgaacattcagcggcggcgaataaagaagatatcgggttgcgggaggttttatatagtactgggagaactttttattcggtttgatctgacttttatctttataagatttggcacggttgcttaattcagccaacgggttaatagtataaataggtgtggtgtaatttctttattttgaacatgtatacgatttgttcgtaaatattcgatagtttcgttgattatctccttttttctttttaatttggcggattataaacataatcttgatattatgaagactgccattgttcctttcttgttgcttctgaatattcttgtcgctgtaaatgcacagactaaggattctgttatcttggtgaaagatagtattacggtaaaattgccggatgtctacgttacttccgagcgtcctttggttacggttacggacgatgccttatctttcgacgtgcctaacttgatcatggccaaaccggtgaatactgcatttgatattttaggagagattcccggattggtgaaagaaggggacaacgttagtatcatcggcgtccctactacgaacattattattaacggacgtaaaagctcaatgtcattgtcccagattgtagagcttctgaaatctaactcggccagcaaagtaaagagtatagagcttttgtatagctctcctccaaaatatggcgtaaaaggaggtagtataaatatcattatggagaagaaagtgaatgaggatttaagtgccgatatctctttgaccggaaagcaagctttctacttctcgccaaccgggttagtgaatttatcttactccaaaaagaaatatagtctggatctatcttattccgctaattataaccattcccgttcaaccgaggatatgaacgcctatcctatcgtgaaggatcgtccttatgagatcctgcaagaaaatacggcggtaggtcgttccatgaaccatacgattggggcaagtgccagttggtttatggataaggggcgtgaggtggatatttcttattatgccaagataacggattctaattccaaacgatattcgaacactctatttgtgggtattgagaatgcggaaagtaataataagttatcgggcccgaagaatcttcaaaatgtacggttgaattatgcacattccaagaacttgaacgcaggggtggattatacctattataaggatcgcagggatcaatatatgatctcggattatcccgatacgaaacaagaggtggaggctacctcccggcaaaatatccatttggcgaatgtattcgttaactacgaacgggtattaggaaaaggatggaaaattaacgtaggcacgaatgtgcagttatcctttacggataatagctcctttacctaccaagataaacaggaggatctgtcagctacgtttgcccaaaaagaaaaagagtatacggcgggattgtatgccggtttctctaagcgttttggcaagaaactggtgttgagcgcttctctttcggcggagtataataaggcggtgattgattcggcgggccggaaatggaccttatggtctggggtaaatctctatccacaattgaacttgagttatacgatcgatccatcgaatatgcttcaagtcaatttctccagcgataagaagtatccggcgtattgggtcatgagctcgaatgtttcttatttgaatgtgtatagtcaggtacggggaaatccttatttggaaccggaacgtatttatatggctagggctaattatatcttgaaaaagaaatatgtttttggactattcgccaatcatcatgtgaattatattcgccaattgtattatcaagatacgaaagcgttgagagcctattaccaatcggttaatttcgataagcataatactttcggggcgatggcagttatcccgtttcggatcggtggggtggttagctcacggttcgtggcatcgggcttcttgattcaagatgagggagtgtttatcgatatttcgtttgatcggaaaaagttgttcgggcagttgatgttgttcaatacgtttactttatcaaggaaaaagaacttatcgttagaagttaacgctcgctatagtgcgccttcgatacaaggtatctatgatgtggatggtatttataatgtatcggcagggcttgtctggaacccgataccgaaaaaattaagcgtaatgctacgaggtgaggacttattaaagggcttacgtgcgaaaacgcatattgattatcccagccagaagagtgatatgacgatctattcggatactcgttctgtatcgctcaccttaaagtatacattgggcaagatgaaccggaagaataagaaagagatcgattcttcacggtttggtcaataaagttcttatggaatccattcgataacgcctgtgactggatgttgttttttccagtcctctaattccgcatacgtacgcacgccgtcttgaatgactgcttggtaatattccacgcccatgattttcgctgtatccggtgtctcatatttcagttttaagatggcctgccgggtctcgtcagtcagtacggcggttatacgttcggccattttctcgaaataaccgtcataacgggaaccttttacgatatggatcatatcaatttgccagagttcgttatccgggtcttggaaccatgcgtgccactctacgcattgttcttccgtatcgagcgaatttccgtattcgatccgtttaatgagcgggttctccgctagtcgggccatcgctaggaagctgtcggatatacggaaaggagaagtgtaaatatgaaagtcgatatccttatgtttcatgagtagtcccatattcaaggagcctactaggtttatttccgccccgacggatttccatatatttataatgtcggtttgccggatcacttcccaagctctatcttggtttcttttcgctaattctaatagatgtttcatgatttaaataatttgaggtgtgaagttaagacacgaagcgggataaggaaatagctatttatagctaggttggttttaatatatcatacgggtacactatttccggttgtagggacggggcacgccccgtccctataagttggacaatatatatttatcttttgaataaccggaataactcaccgatccataaaaccagagaggaagatccgataatgatcgcccaatcttccaagggcaaaggtattacgctgaacatctcgcctccaaaagtgacgattaagtattgaccaatcaaaatcagtaaagcgaccagcaagaagcttttactatcctttaaattggcaaaagcggaacgtccttccataaatgcctttgcgttaaacatattccagaactgtagcatcacgaagaagctgaagaaccacgataaatcgtgcggcgttaaaccgtcttgcgcatggaaatagaacaacaagcccatcaagattacgacaaaagcgaatccgacgccgaaaatattataggccatcgggcgggtgataatgaaatctccatccttaccgctccggcgaggtttatctttcatcactcgctcattcggtgggagagaggccaacgccccggcagcgaatgtatccatgatcaagtttacccataacatctgcgtgatagtcaaaggagattccgtacctaataaagaacccaatagcacgatcaaacaagcggctacattgatggtcaattggaataacaagaatttctggatattccggtacaaggaacgtccccacatcaccgcacgggtaatgctactgaacgagttgtcgataatcgtaatgtcgctggcttccttggcaactgaagtaccgtcacccatggagaggcctacttgtgccgctttcaaggcgggggcatcgtttgtcccgtcgccggtaaccgctaccacggcgcctttctgctgtaataattgtaccaaacgctgtttgtccgtaggacgggcacggcacatgatcttcaagtctaagacacgatccaaggcctcttggtcgctaagcgcctcgaatgcgggacccgtgataatgttccggtcggtatcattcgctttccacgtaccgatctgtcgtccgatttctttagccgtacccggtgtatctccggtgacgatcttcacgtcgatacctgcgtccaagcaactttgaacagcggggggcacatccgcacgtaccggatcggagatagcgacgatacctaggtacgttaaatccgtatcatgtaaacgaccctcaacgaagaaggtctcatccattccatcctcaattatctggtaagcgaagccaagcgtacgcatcgcttggttctggtaatccaataattgtttttcgatgccggctttacattccgccaccggtttgtaagttccgtctatcgccacccggttactgttggccagtacgatttcgggagcacctttcacgtaaagtaccttcttgccgagtaacggtgattgtacgattgtagccatatatttccgttccgtagagaaggtcaattgatctaggatcgtagcgttctctcttaattccagataattttggtgttgtccgttcaaccagagtaaaagggcggcctccgtcgggtttccaagggtttttaccttttcttccgagaaatcgaggaatgccgtggagttcgtggagataccttctttgatcaggttacttaactcatcctccccaagcttttggtctttcaggttgtagaaattcgtttggtagacttgcatttggttctgcgtcaacgttccggtcttgtccgtacaaattacggtagtcgctcccatggtctcacaggcgtgcattttgcggacaagattattcgtcttcaacatacggttcatgctgagggccaaacttaacgtgacactcatcggtaatccttccggaacggataccacgatcaacgtaaccgctaccataaagtagttgaggatatgggcgatgatgtccatcgccggcatcccggggaaactatccgataaaaggaattttacggtcaaggcgatgaacgtcaccccggcgatcgtatatccggctttactgatcacgctagccaagcctttcaactgtatttgtaaaggagtctctacatcgctctcgatttgcgagccttcgtagaccttaccgtatccggtagcgtcacccaccttttctacttgcattacgccatgtccgtccacgaccgtcgttcctcgcatgactacattggacggataagtcgcttccgtatcgaaatccgcctcgtttgtagtcttgctgataatcggttcaccggttagtgtggattcgttgatctgtagggagatggcttcaagcaaatgtccatctgcgggaatttcctcacctgtctccaaaacaacgatatcgcctacgacgacctcttttttcggtatttggcagatattcccgtcacggattaccttcactaaaatatcatcattgactgtattcaagatatcgaatgccttgttcgctttcacctcgaagaaaaagcccacgcaactggcaagcatgattgcgaagaaaatgccgatcggctccaagaaggccgtaaaacctttcgcctcaggtccccagcaatgtacgccagcgattatcatggacaagagccatgccactaataatatacgaataataggatcttcgaatttctccaagaattggctccataacgaagctttcttgggcggggtaagtacattctcgccgtgaaggcgcctgctctcttctacttcttgtttggttaatcctcggtactgatgttttttctccataaatttattaatctgattaagaaaataggatagcaaattacgtaaagttatacgacatatacaagggtttaacctttttgcatatatttgtgttgtataacaaattaatttttaattaaaagatgaagaaagtactattcatgttattggttatgttcgctttgagcgcctgccaatcaaaggattcatatgtgaaggagtttagtgattttgtagataaggtggaaatggaggccgctgattataccgataaggactggaagaaggcggatctgaaattctcggatctatccacggatctttacgccaagttcgaggaagagttaaacgctgatgagaaagcggagatcattaaattgcaagcgacatacgctggattgaaaatgaaagcgggcgtgaaagacgctgccaaaaaagtggataagttcttggatggtttgaaggaaggaacaaaataacctctaatacgaaaataagatgaacagaaattgggtgtattcgctatttgctttatggatcgtctgttcgttcgcctgtacgcagcctaaacctgtggcgaatgtggatgttcaaaaagagaatttcgtattctctataaaagggacagatacattgtccttggacaagtatgagttgccttctatatcgcccgcctcaaaaaagcctgtgatgatttttgcttttggcggtgggtttaaagggggagataaggcggataaaggatatattccctatttcgagttcctcgcccgaaacggatttgtggtcgtttctacggattatcgtaccaccttgaagaatctggatccttctaaagtctcttctccgatggactttatcgcagccttgcagcatgcgatcgatacggcggtagaggatttttatgatgctaccggtttcgtgattaaccaaagctcggattggaacatcgatgtggagcagatcgtagcgagcggttcaagtgccggggcgattacggtattgcaggcagagtatgatttatgtaacggacatgagttggcgaaaaggctaccgacaggtttcaactatgccggtgtgatctcatatgccggtgcggtctctggtgtgcttcctccacattgggaaaagatgccttgtccgattatgctattccatggcgatgcggataaaaccgttccttttgaacaagccgctatggagaacctcggcggtttatggggatcatccgctgtagcgaaaagtctggaaaatcttcaagcttcctattatttttataaggtagagaatgcggggcatgagatctctgggcttcctatgtcccggaaccaatacgatatcatgagcttcttgagccgtcaagtcttaggcgatgagaatttagcgatcacgacagacgaacgtgttcccggtgatacgatcgtacggaaagattttaccgtacaggattatatcttggataatttgcgttaatataataatgaaatataaacagccttaatttgacctttttagattaaactattcacccgaaggattgtctttactatatagagtgattaatagtgtgtttagtttattaaggttatgagattaacaaggttagttggatttttagggattgtccttttttgtgcagggcaatccctttttgctcaaagtaagcaagagcggaaggagcaaaaagagaaagtagtgagggagatcgtggatagcggttgtattaagatcgatgtggatcgtgccgtaccgatggccgggagatccgtcaatcttacttccccctactcattggaaatacatggtgactcgatcctgtcttatcttccttactttggacgtgcttactctgctccttatggtggtggagagggcttgacgtttaaagaagtggcgacagagaaggagcaaacctctgaaaagaaaggtagttccgaaatcaagttccgtgtaaagaccaaagaggatgtatacatgtttcgggtggaagtctatccgaatggctcggtgacaatcaatgtgacacccgtgaataaacaggctattaccttttatggtgatgtcgccttagacttgaaatagtcgtccttgccgtgtatctctttcctcgatccgcttatttaccttagcggtaaattcgaaattctttaaaccccaatccggtgcgatcagtagctctttgggggattgtgatacgaacctctctactacgatagaggggttcagtcgttcaatgaagtcaatcactaattcgatatattcatcagccgtatataaatggaaatcagaaggatcttccttgaactctttcgccatgcgggtattcttgattagctgcaattggtgcagtttaagtgtcgtgatcgggaggcgtgataagacatccgcatggtgtaatatttcatccctactttctcccggtagtccgagtatcaggtgtgccccggtgtaaataccttttgccgccgtacgacggatagcggattccgattcttcatgggtatgccctctgtttatgcggactaaggtcttatcaagcgtactttccaatccatattcaatcatgacgaattttcgctgggaaagctccgcaaaataatccaataaaccttccggcatacagtccggacgagtgccgacaatcaatccttccactccaggataggcaagcgcttcctcatatttgcgaataagagagtctaatcggtcgtatgtatttgtgtaggcttggaagtaggccagataccgcatatccggatatttgcgggaaaaaaaacgtacgccttcctctaattgctcggtaacgcttttctccgtatgacagtattctggactgaatgtttggttattacaataggtgcaaccgccccatcctttagacccgtctcggttcgggcaggtgaagcctgcgtttatggaaatcttctgaaccttgaatttgaatagatcccgtagaaaatccccaaattcataatatcgtttagtttttttcataagacaaagatacgatttctcgcaatttgaatcacttttttatgctaacttcgcgtttcaatctgaaataaagagtataaatgaaacgattaggttttagtttattgctttcgttggccgtattcggaagtgtggccgcacaaaccggaagcaagcatgttgacttaaaagaaataaccgatgggaaatttcgtcaagtgacggctatcggagagatgcgatccttgccggatggagaacactacacagccatgaacgccgataagagtatgatcattaaatattcctatcgtacgggaaatcctgtggatacattgtttaatgcccgtaaagctcgtgaatgtacctttacggattttgatggatatacaatcagcagtaccgggcatcatatcttggtttggagggatacggagtctatttatcgtcgctctactaaggcggtggtttatgattatgacgtgcgtcgtaattatgtgaagcctatttccgatgccaagggtaagcaaatgatcccgactttctcgccggatggtcgtatgtgcgcttatgtacgggataataatatttggatacgtaagtttgatttcgacacggaggtacaagtcaccaaggacggtgagttgaataagatattgaatggcatcacggattgggtgtatgaggaagaatttgcggtgacaaatctaatggcgtggtctcccgatagcgagtatctggcctttgtccgttttgacgagtccgaggtgcccgaatattctatgcagatgtatggtgagggactttatccggggtattacgaatataaatatccgaaggccgggcagaagaattcaaaggtttccgtacattcttatagcgtagtcaccaaagacacgaaggagatgaaggtcccggtagaaggtgacttctatattccccgcattactttcacgcagaatccggatcagttggctatcatgacattgaaccgccagcagaatgtattcaatatgtattatgcaaatccgaagagcggtgtgttccgtttgatcttgcgtgaggaaaataaatgctacgtggattctgattggttgacttccatccagttcttgaacaatgggtttacctatgtgagtgaacaagatggctattcccatatttatttgtattccccgacaggtgttatgcaacgtcaggtaactcaagggaactgggatgtcacgaagttcttgggcgtggatgagaatacgaagactttctattacgagtctgccgaagaaagcccgatccgccgttctatctataagatcgacgctaaaggcgtgaagacaaaactctctacggaagagggtatgaataaggcggtctttagtgacaatttcgcttatttcgtaaatacctattccaatgcgaataccccggcgaagattacggtgaatgagacgaagaccaaaaaggaactacgtgttctgcaagataacgccgcgttgaagagtaagctgaaggaatatgtttttgctaagaaggaatttatgaagatacatacggcttcggattatgagttcaacgcttggatcgtaaaacccgctgattttgacccgtcgaagaaatatccggtgatgatgacgcaatatagtggtcctaactcccagcaagtattggatcaatacggtttcgattgggagcaatatctggcctcaaatggtattatcgtggtatgtgtggatggtcgtggaaccggtgcccgtggtgaggcattccgtaaatgtacttatttgagaatgggcgagctggaatccagagaccaagtggaggctgcgcaagcgttgggcaagttaccttatatcgataaggatcgtatcgcgatctggggttggagtttcggaggttataacacgttgatggccttgagtaccggaaacggaacgtttaaggtgggtatcgccgtggctcctccgacggactggaaatattatgactccgtttatacggagcgtttcatgcgtaccccgcaagagaatttcgagggctatgcggctacctctccgttacgccgggtgaaagacttacaaggcaagttattgctggttcatggaaccgccgatgataatgttcattttatgcaaacaatggaatatgccgaggctttggttcaagcgggtaagcagttcgatatgcatgtttataaagatcggaatcatagcatatacggtggtaatacccgttaccatttgtatacgaagatggctaattatttattcaataatttgtaagacatggcgcagcatttaagaaagccggattggttgaagatccggcttggcggaaatgagcaattcacgaagacaaaaagtattgttgaatctcattgccttcacacaatatgcacaagtggtaaatgcccgaatatgggtgaatgttggagccggggaacagctacattcatgatcggtggtgagatctgtactcgctcttgtcgtttttgtaatacgctaacgggtaaacctcttccgttggacccgaaagagcctgcgaatgtagcggagagcatccgtttaatgaatctcaagcatgcggtgatcacgtccgttgatcgtgatgacctaccggacttaggcgcttctcattgggtaaatacgatccgtacgatcaaagaggtgaatcctcaaacgactgtggaagtcttaatcccggattttcaaggacgattggatctggttgatcaggtcgtggatgcggcgcctgagattatctcccataatatggagactgtacgccgtatcagtccgcaagtgcgtagtgccgctaagtatgacgtgagcttatccgttttgcgacgaatcgctgagcggggtgtggtagccaagactggtatcatggtcggactgggtgagaccgaggatgaggtgcttgaattaatggatgatgttttgctggcgggtgtttctgttttaacaatcgggcagtatttacagccttctcgcaagaatattcccgtctctgaatatgtgactcctgaatgttttgaatattatagacagcaagccgttggcaaaggttttaagaaagtagagagcgctccgctggtacgctcgtcgtaccatgcggaaaagcatatatgattcatgaacttttgacaatctttgttgttattaatataaaagtggactaaagggggggaaggaatgaacagagtaaagaaaggtctagataatcaggcgataggtttattgccattgttgttattcatgtttttggataactatttttcttatttattatcttttataattggggttactttctgttttgtttgtatttttttgtttcaggtgttgagcaaggataaggtataccaatttatgcttctgccatcggcgggcacattggtcttatattccgtatttctttgtctcaagcttgaaccagtgttgtttatatactctcctcttatcacggaagtattactggtcgtggcgttagcgatcgtggggttcacgaggagaacggtcatacaacgtatacgcgattcgaaacgtccctcttttaaacgtactttgcttcgtactaccttgaacgaattttatttcctcgctcagttggtacagaacctgtacacgttgcatcttttcatcatcttgttatatagtatcttgccggaaacgatgcagaatatgcgtaccgaacgtttcttataccgggagttgggattggtaatcggtgttttggtcattgtttatgagcaaatacgtttgtccttgatgcaaggtagcttgaaaaaggaaatgtggcttcccgtattgaatgacaatgggaaggtgatcggttgtatcgcacgttcggtcagccgctctttaccgaagaaatactatcatccgatcgtgcgtatcgccgttgtttataatggtatgttatatctggtgagacgaagtaaggatgagtttgtctctccggatacgatggattatccgttccataattacgtgctcttccgacatagtatagatagtacggtcaaagagactctcggaagtttggcgcaagataaatcaattgctccacgcttcctaatccgttatacatttgagaacgagaaggtgaaacatttggtatctctctatgttatttgtttacgcacggaagagcaattaaatcaatgtaagcgccgtagtggaaagctttggacagcgaaacaaatcgaggagaacttgagctccggggtgtttagcgaatattttgagaaagagttcgcttatttgcaaaatacgattcttttcgccgagagtttctgttgcggtaactaatcatcttataatgcccggttccctagctctataacttccaagtctttgatatcctttccctcaataacgaaacgtaataaggtacgtacttgatgaaagccactttttccagccgctcccggattcatatgcagacacttcaagcttcgatcgaatactactttcaggatatgcgaatgtccggatatgaatagatttggccgtgtatcgtataattctttgcggatctcgggattgtagcggcccggataacctccgatatgagtcatcataacgttcacgtcttctaccttgaaatgagctactttaggatattgcaggcgaatggcttgtccgtctatatttccgtatacagccctaaaaggtttcaatgcctcgaatttcgcggccaaaagatcggagcctatatcgcccgcatgccagatttcatcgcaatctttaaaatattcggcatacttgtcatcccagtacgcatgggtgtctgaaagcaatccaactttaatcataacaatttcttttattgctcgaaagtatctatatttacacgcctaagataagaatattatggagaattcatatcaatattttaaacgggacttaagctggttgtcgtttaactaccgtgtcttgctggaagcggaagatgatacgctgcctatttatgagcgtattaagttcctttctatctattcctcgaatctggaagaattttatgagatccgggttgcggagcatcggggggtaatcatgaaaaagaattattcggaggagagcgcagctgaggcggaagagaccttggcggctatcacccgggaggttaaccgccagcaacgggactattaccgtattttctcggagaagatattgccggaattgaatcaccagaatgtttacttataccagaatgagaagccggaacctttccatgaagagtttgtccataatttctttaatgaggaggtttttccattcctgtcgccggtcatgattcaagccggtgatatacgtacgttcatccgggatcgtcggctttaccttgtgatccgtatgattaagcggagcaagcggatgaatgagccgggcttcgtacccgagtatcattatgcgttgatgaagattccttatgcgaaagttcctcgttttatagagttgcctccgcatgacgggaaatattatatcatgtttatcgacgacattatccgtgcgaatttacagaatgtttttcccggttatattattgatggctgttacagcatcaagatttcccgggatgcggatatttatttggatgatgagagccgagcgaatatcgtggagaatatccgtaagaaggtgaagaagcgcaagatcggagccttgagccgttttatgtatgatcaagcgatgccggatgattttctggcttttgtttgcgatgcctttggtattacgtcggaggacttggtgttaggtggacgatataataatttgcaggacttgatgaaattgccgaatccggcgggaaagcatttggagcagcagccaccggtgcctatgcgtgtgcctttcctcgatgagatggggtcggtattcaaggccgtgaagaagcgggatatcttattgcatttcccttatgagtcgtttgattatttgatccgcttcttgatggaggcggcctttgatccgaaggtggatgagatcaagattacccagtatcgagtggcagagaattcggccgtgattaatacgctggtcagcgctgcccagaatggtaagaaagtgacggtattcgtggaattgaaagcccgtttcgacgaggagaataatatgagtacggcggagcgtatggagcaggccggtattcgtatcatttatagtattccgggcttgaaagtacatgcgaaggttgcggtcattcttcggaaggatacgtccgagggacttaaacggcgtgatttcgcctatttgagtactggcaatttcaatgagaagacggctaagatctattcggatatggcgttattgacttcaaacactgagattattacggatatcaataaagtattcgctattttggaagggcgtatgaaagagcctactttccgccatttgttggtggcccgtttcaatatggtctcagaattgactggtaggattcggcgggagatcgagcatgtgcaggaaggccgaagaggacggatcatattaaagatgaacggactgcatgaccaacatatgatcgaggaactctatcatgccagcgaggtgggggtcgagatcgatctgattgtccggggaatttgttgtctggtaccggatcaaccttatagcgctaacatccgggttactcgtatcgtggatatgtttttggagcattcccgggtttggtattttctgaatgacggtcaggaggatcttttccttacctcagcggattggatgcgtcggaatttgaaccgacggatagagacggcttttccgattcttgatccggacctgaagagggagataatcgatatcttgaatattcagctaagtgacaacgtaaaagcttgttatttggatggcgagttacgtaataatttcaagtgtgatgataatccggtaaaagtgcgttcgcaattggctatctatgattatctgagaaataaacccatacggtaactgggatgggggagttatggggatttgtcgattggggggctggttgcttagctttgatcgtggcggtggtatttagctttttgttgggagtacgtacggggcgtatccgggagagaaatgaatctgtccgttctcgcattcggcagaataaagcgaatatgtatcgctataaacaacaattagcctcctatcaagagcaagtcgtacgcttagagcgggaacgggattctctggttatccgctcggaggcttatgaccggatcgagacggagctgacggcctatcgccagaagatggagcagttggagagagagatccttgttctttccggcgataataacttattggacaatgctaccggaaaagtagatgtggatgtacctaagcttttatgtgcccttaaagatgatcctctccatgtgaatccaagtaaagaggaatgggctgagattattggtatgaccgatcttctgtttaataacttcttaaccgatctgagaaataaatacagtattacccgccatgagcaggaaatatgttgcttgatcaaatggaatttctcccgaaaggagcaactagccgtgtttaataatactccggatgcgttaaccaaatcgaaaggccgtttaaaaaaacgtctaggcttggatgaaaagacggatttggatgcctatgtccgtttattataaagcttaaagttattttgtttgtcgtgattgtccggcaatattatctgtttatctcccattgcgtggtttatatgtgtgattattagttgtttgatgttcgcttgttttgtccggtaccatttctttcctctttacgatccttcctgtacttttgcggtgtgtgatttaatttttaagaacgaataatcaggaatgctatgagaacacaaactgtactactatggatctgccttagcctaatggtggggctttccgcttgtgattggacttcgtcctctccggtggcctcgctacggcgggctaccggatggcctttcgaggtggtggttgtaatggatcgagacgcatggaatggtgaggtgggggagttgctgcaagaacaattgcgagcgccgatacctgctttgcctcaagcggaagcatctatgcgtgtcacctattcggagccatcgggcttttccggtttattacgatacgtacgaaatatcttgatcgtatccgtagatcctaatcggtatacgaaagctggaacaagagagagtcccgatgaatgggccagcggtcagaatgttgtgaatctgtatgctccgactaccgcagctttaaccgagttccttttattaaatgaaggacggttggtcaaccatttcaatcgagtggaaagggagcgttggataaccgggctttctaagagccatagcagctggatcaatgagaagttgaagtcccgtttcggtatctcgctgttcgtgccggaagatatgtcggcctataaggaagagaccgatttcttttggggctcgaataacgcgaatcggggacggactgatatcttggtatatagttttccctatacgactcaagaggcatttaccgaagattatctggtcgctatgcgtgattctgtaatgaggcggaacgtaccgggctctttcccggattcttatatgaagactgagaagcgcttcgagctttcttacgagccgattacctaccgtggcgaatactgcggcgtattgcgtggtctttggcggatggaaggagataagatgggcggcccgttcgtcagccatgccctgctcgataagaaaaaagggcgggttatcgtagcggaaagctttgtctatgccccggaatcaaaaaaggcgaacttgatccgccggatggaggccgccttgtttacgcttcggtttatagggcattgattattttattaaaagcatgaatgtttggctagtaagtgttatctttgtgataagtaaataaagaatgagatatggaaagaactgtttttaatgcagcgcagctacagatattggatttaatgtcgtatgtggaaagtgaggatacgttaaacgagattaaggatatgctatcgaattacttcgctcagaaagcggaaaaggcgatcgactcattgtgggatagcggccagatcaatgatacggtcatagatcaatggaagcaagaacatttacggactccttataactcggcgagatgaataggatcgtgttggatacgaattgcctcttgatatctctttcaagaagaggtcattattatgcggtttggaaagatttctttgcggaaaagtatgtattatgttatacgaatgagatattaacggagtacgaagagattctcacgttgaaaatgagtcgtgaaatagctcaaaatatcatcaaggcgataattactcgtaaaaacacgctgagactggatgcacatttccgctttaacttgattcaagcggatgtggatgataataaatttgttgattgtgccattgctgcaaatgcctcttatatagtgagccaggatcatcatttcgatatacttaaaacaatagaatttccaaaggttgagttgatcgatattgatacctttatggctttgcttgacaatgagctttaatctaatatcgcctttatgtgaacgttaatccgatattatttctgatcttaatgtgcttattgaaacaaccggatttcctccggaatatatcctgtccgtatacgccactcttgcggatacaggttattggcccggttgccaaggttctttacaaaacctagcggaagtccttggtagcgtaccaacacatatcccttatctgtaccggagggtaagacgagtgcctctttcttcaagaatttaatagcgtcttcccattccagttccacggatggaaatgcgttgggggttaaggcggtacttaaagccagctcttgagatgggataaagtctttccctttcgcttctcctaggcaaataccggcggaaagtacccgtaaaggcttggcattgatgagtgaaaatagatccgaatgggctttgggatacgctcgaaggaaactgccgttccattcgagagaaaatgaagtttcatccgaaaggaactgacgggcctcctgtgggatggacggagcggcttttccccgctcttttttccctttggacttgacacgaatctcctcgatctcgccttccgctttccggagggcggcgaggaaaaagccttcgccccgtgtcttatgcgggaagaagcgataaaccggatgttcaaaccggagggcgccggtgatctgccattcctcttgggtagggataggcaatgcctcggctcccagctcctctattatataatgtatgttctcctcatcctcttccgtattataggtacatgtactgtagatcaagagacctccgggtttcaaggcgttccagatatcatggatgatgcgccgttgacgggaggcgcaaagccgtacgttatctacgctccattcacctgtgctatccgtgtccttccggaacatgccctcaccggagcaaggtacgtcggtgacgatcacgtcgaacagatgaggcaatgcctcgccgatctcctccgggtcattattgataacgatcgtgtccgggcggccccatttagcgatattctcggccaatacataactccggctacggatcacctcgttactgactaacagactaccctccggcaataagctcgccagatgcgtggacttaccacccggggcggcgcataaatccaagcaacgtaccggctctttcacgtatgccttgatcgcttgttccagaaacatggaagacgcttcctgcacgtaataggctcccgcgtggaatagaggatcgaaggtgaaagacaaccgttccggcaaataataaccactctcgcaccaagcgaccggagcacctgctttgggagcaggagtccctttcatcgggttgatacggatgcttacgggaacatcagcacttaacgctgcctctaaacgatcgaactcctcgccaagtaaagcccgtgtacgggtaataaaatcaataggaagtgccatgattattctgttagtttgcggcaaaaatactacttttgcggaaaacaaacagtatgcaagcatctcttttccttataccagttaccttgggcgatacggaacatcgccgtgttttaccagaatataaccgtgacgtgatcttatccatccggcattttatcgtggaaaacgtgcgtacggcacgccgtttcttgaaaaaggtggagccggggatcgtgatcgatgacttgacattttatgagctgaataaacatacctcaccggaacaagtagctggttatctagctcctttggcgaaaggcgagagcgttggcgtgatctcggaggcgggttgtccggcgatcgctgatccgggtgctgacgtagtggccattgcccaacggaaggattatccggtggtaccgttggtagggccttcgtctatcttgatgtcggtgatgggatcgggctttaacggacagagtttcgcttttcacggttatctgccgatcgatgcttccgagcgaacgaacacgatcaagaaattggagggaagaatttattccgagcatcagacacaattgtttatcgagactccttaccggaataataaactggccgaggagttgatccgtacgtgccgtccgtctacgaaactgtgtatcgcctcgaatataacgtgtgaggatgagtatatccatactcgcccggtcaaggaatgggcgggtaaagttcccgatctgagcaagaagcctactattttcctaatctataaataagaggattgatatgagttatcaagcgcacgagacagcggtaatcgatgccggttgtgagatcggggaaggaacccatatctggcatttttcccatatcatgacgggatgcgtgattggcagggcgtgtaatatcggccagaatgtagtcgtatcgccgggcgtggtcttagggaataacgtgaaggtacagaacaatgtgtctatttatacgggggtgatttgcgaggatgatgtgttcttggggcctagttgcgtgtttacaaatgtaaccaatccgcgtagcgctgtctctcggaaagaccagtataaggagacggtgattggcaagggggcctcgatcggagctaacgctacgattatttgtggacatacggtcgggcggtatgccatgatcggtgccggggcggtggtaacgaaggatgttccggcttatgcgctggttgtaggaaatccatcgcggcagatcggttgggtaagcgagtacggccatcgccttgtatttgactccgaaggattcgccacctgtccggaaagcggccaacgttaccgcctatacaatcaccaagttgtagagacggggcgtgccccgtctcccacagactgatcgtatcttaaattactattttgcagggatgagacggggcacgccccgtctctacaatacagacaatattaatattctatacaaacatgaaaacatcttttttcaagcaagggttcttagcgatagggatagcctgttgcatgcagctttccgccgtagagaatcctgtagactacgtgaatacgttagtcggtacccaatccaagtacgaattatctaccggaaatacctatccggccacggctatgccttggggtatgaacttctggactccccagaccggcgagatgggcaacggctggacctatcgttacgacgcggataagatccgggggttcaagcaaacccatcaaccgagcccgtggatgaacgattacgggcagttctccattatgcctactaccgaaggcttggtcttcgacgaggagaaacgggctagctggttctctcacaaaggggaagtggctacaccttattattataaggtctatctagccgatcatgacgtgactaccgagttggttccgacggaacgtgcggctaagttccgctttacattcccggaaaccaagaaagcgtatatcgtcatcgacgctttcgataaaggctcttatataaaggtattgcctgcggaacgtaagatcatcggttattccacgaagaacacgggcggtgttccccgtaacttcaagaattatttcgtgatccaattcgataagccattcacgttctcctctacggttaagaacggggcgatccagttggatgagtcggaggtgaagacaaaccatgccggcgctatcatcggttttgagacaaaggccggcgaggtggtgcatgccaatgtggcttcttctttcatcagcactgagcaggccgagttaaacttgcgtgaggtgggagatactggtttcgatcagctagtgaccaaagggaaggaaatctggaaccgggaattaggtaagatcgaggtagaggatacgaacatcgataacttgcgtactttctattcttgcttgtatcgttccttgcttttccctcgtagcttctatgagatcgatgccaaagggcaagtcatgcattatagcccttataacggtgaggtcttgccgggctatatgtttaccgataccggtttctgggatacgttccgttgtcttttccccttcttgaacctgatgtatccggagatgaaccaaaagatgcaggaaggtttggtgaacgcttataaagagagcggtttcttgccggaatgggcaagtccgggccaccgggattgcatggtcggcaataactccgcttccgtggtagccgacgcttatatcaaaggcttgagaggatacgatatcgagacgctttgggaagctttgaagcatgacgcgaatagccaactgccgagaacggcttccggtcgtgtcgcttacgaggagtataataaactgggttatgtaccgaataatatcggtatcggacaaaacgtagctcgtaccttggaatatgcttataatgactggacaatttatgcgttaggaaagaaactaggcaagccggcaagcgagatcgatatcttcaagcaacgggctaacaactataagaatgtgtacgacccaaaatataagttgatggtcggacgctctgataagggcgagttcaacccttcttttaaaggtacggactggagccgtgatttctgcgagggtaatagctggcattggagtttctgtgttttccacgacccgcaaggtcttatcgacttaatgggaggaaagaaggaattcaaccacatgatggattccgtcttcaagatgcctagtcgtttgggtatggatagccgcggtatgatccatgagatgcgtgagatgcaagtaatgaatatgggacaatacgcccacggaaaccaacccatccagcatatggtatatctatacaactattccggcgagccttggaaagcccaatactgggtgtgcgagatcatgcacaaactttataccgctgaggcggatggctattgcggcgatgaggataacggacagacttccgcatggtatgtgttctctgccttaggcttctataccgtatgtccgggcaccgaccaatatgtattaggtactcctctgttcaaatccgtaaaactccatctggataacggaaagcaggtgttgatccaagcggacaaggctgatcgggagaaccgttacatcaagggtatgaaagtaaacggcaagacatacacccgcaatttcttgacacatgagcagttgctaggtggcgcaaaaattcaataccaaatgagcgatacccctaataaacagcgaggtacgcaggatagtgatcgcccctattcattctctttggaataagaaaaccatgatgcccattgtaagcctgttacaataggcattctaagcaccttacgatgcccattgtgaagaccttacgatgggcattgttattttatgtgaattccggtttgaaataatgatggagagagttgcgttttaccttagggttgttacctttgcgatgactaatcagtttttctatcctctttgtttatccttttaatttagatgtatggcaaactcaaaagagatgacgaggggtgctgtattccctcttctattcagtttcacgatgccattgttattagggaatctgcttcagcagacttattctttgatcgatgccgctatcgtaggtaaatttctaggtataaattcgctggctgccgtaggagccagtacctcggtgattttcttgattctgggattctgtaacggatgttgcgccggttttggcatcccggtagctcaaaagttcggggcgagggattatgcgacgatgcgccgttacgtggcggtggggttgcaattggctacggtgatgtccgtggtgatcgccgctgtctccggtttctattgccgggatatcttgcgggggatgcagacacccgggaatatcttcgatggggcctatgattatttgtttgttacttttatcggtattccttgtacattcttctataatttgttggcaagtatcatgcgggctttgggagatagcaagactccattctggttcttgctgttctctacggtcttgaatgttttcttggatttattctgcatcttggtgctaggatggggcgtgatgggagcggctatcgctacggttttctcgcaagggctttccgccattctatgttatttatatatgcttcggaaatttccgatcttacgggctacttcttccgaggatcgaaggtttcatgccgggctggcccgtaccttattggcgatgggggttccgatgggattgcaattttctattaccgctattggcagtatcatgttgcagagcgccaataacgccttgggcacggcctgtgtcgctgcctttacttccgccgcccgtatcaagatgttcttcatttgcgcttttgagagtttgggtatcgccatggctacgtattgcggacagaattatggggcgggaaagccagagcgtattttgcagggaattaaagtgagttcgttgatgatgcttacgtatgccgccgctacatggatgatcttgatgctggggtctcgttggctggccttgttgtttgtggctccatctgaggtcgagatactggactatacggagcagtttttgcatatttctttctggttcttcccggctgtcgggctactgtgtatcttgcgttacgtgatacaaggggtaggttttagcaaccttgcgatgctctcgggtgtttcagagatgatcgcacgtgtcttggtgagcttgtatgcggttcccgcttttgggttcttgggcgtttgcttcggtgatccgttggcttgggttgccgctgacttattcttgatacctgcgtttttgtatgtttataaaaagataaagaaaagattagatgatgagaaagtatcggtgtccgcagtgtgatatcccttctatgtatgtaaagaatgcggcaggggaacgtcttttagtgtatgttcacgagaatggggaggtcgttcccaaagatcccactacggatctgtccggatttgacttgacagaggtattttgcctaggatgctcatggcatggagcgcctaggaaatgccggtgattttaatgggtggcaagttcttataagtcttctttgggtaattctctgatcactctacatgggttaccgacggccacgctataggtgggaatggattttgtcactacactgcctgccccgatcacgctgttcctcccgatcgtgatgccgggtaagacgatcgttccaccaccaatccaaacattgtcttcaatggtgatggggagggcttttgtcctgaaaaataaatcccccgatcgttcgtcccaatcattcacgaagcgttcgttcgcatttatcgggtgcgtagccgtatataattgtacgttgggggcgatgaggacgttatttcctattttgataatattatcgtctaaaaacgtacagttcatattgataatgaccttgtcaccaataaagatgtgcttcccgcattcgcaatggaaatttatatcaatgctggaatacttgccaatgcttcctagcatttggcgtaagagggcatctcttgtagcgctgtcggttatattggttgcgttcaaacgagcgagtaggtttttcgtctggacgatcatttgcaggacttcttgatccagatggttgcaatactcgcccgccaagaacttttgataatttgtttccataatgattacagggatttgatacggttatttacatatgttgaagttgtatatagaagacgatgaaaaaggcgatagtcgcaatcagggcgatagaagaatatagacggaaaggcttatcttgtttatagactccataggctagtcctatcaaggcgcacagtagtataccagtagggatgccgaagaagcctaaaacaatgacgctaataagcattacccatcccatggctattaatattttacttctgatagttctcatctttagtatctgtttagttattggatataatagacaattttagtgttgagaaaatggaatcttggcacgtatctctatcctctcgaaagtgataggatgcgtgaatgctagatattcagcgtgcagatagagccgttccgcctttcgtccgtaaagctcgtcgccaaggatggggcaatgaagacctaggggatgggcggcgtgtacccgtagctggtgggtacgtccggtttggggataaaaggcgataagggtttttccggaagtccgttccaatacccggtagcgtgtaaaggcaggtttcccgaattcttcgcttacgatttgccggggtctgtccaaaggatcgggacatagcgggagacggatctcgccctcatcttggggaacttcgccctctaataaggcgatataccttttctggatggttcggttcttgaattgggcttgcaggttctgatgcgcttctttggtcttggcggcgagtagcaagccggatgtcgccatatccaagcgatgtacgataattgggccggtggcttccggataaaggatcgatagcctttgatagacggagtccacatctcccttgccgggaacggagagcataccttccggtttattgatgaccaacaaatagtcgtcctcataaaggatatccagcttcgtctcccggtgagagtccgccaataacggattttcatctacccgcaatccctgtagcatatgatggaggatcggctcgcattttcctttgcaagccggataataatatccatggtgccggatctccgtcttgggagaatcgccccaccagaactcagccatggcgatcggttccaactgatgctggtaggcgtattgcaagagtttaggggcggcgcactcacccgctccggcaggcggcgcaccttggtaggtaggggcgaacagttcgcataagtccttcacctcgccccgggcgttcaggattcggaattgttcgaacaacttgcgttgcaaggccgccgaccgtcgcttgcgttcttgcttcagttgctcgatctcctgctcaagccgatccaccttggcttgatcctcctccagtatagaccgcaatgatttcttggttagcttgtgagcggctttcatgtgttggctctctttaataagaagtgtggtctcttcttccgtgagagggaactgccgaagtcggtcgcgctcctctttcctctttttcatcaagtcttttgcggcctgtaatacgaaatcgcagtattcgatcgtgctttgtaacctcgaccgtgcgtcttcgagagctggagaggcttgcagggttcggatacgggcattgatctcattgatccgctcctcctcttgccggaagaaaccatccggttgtaataggtcatagatcggggggacgaagaaaggatgtacattcttccccgctaggttaccggagaacgcggccagatagccgacctctccggcgggagtacgaaccaccaatacgccgaacatttttccggtttgtaactcttcccgccattcggttcgttctttcaggtatgcctgcgtctcctcagccgctattacgcatagaggatgcggtgtatagtgaaaaggatacgtgaatcgttccggtaaggggatcgattgtatcggttgggcaaacgtgtgaaacttagattccatcattcattttttaatagacaataagcataaacggccggtgccgtaggatctccctcttgatacaatcccggacgggagatacgatcccattggatcaacgaccgggtctctttcgcggagagagcttcgccgacgatctcgttccatgcttgtccgtccttactccagtagaacgtgctatgcgtaccgttggtcactttcatccgtagatataaaggcgaggcgggaagaggaagatcggccaattgatgttctttcccctctaggatatatttcaatatcaaacggtctccagcgcatccgcaggtgattaggttatttgcgtctccgtacatcgtgattcctttccaactgtcattccggtttacgatcgctgtttctaacgtgtaatccggggaggttgggcgtaaacaaagtgccgctccggtctttacgccgggtttcggtgttccggatagagatagtttaccgttcttgatctcggtcttgacatccgtgtaaggatagttccaactccattcgggacgcaaggtagcaccggtgaaatcatccgagaaatcgaataccggcacttgtgcggactcggcaaatggcatgggttgcgtgcggctcgcatattccccggttacgaagtgaggccaatgatcctcgcccattctcacctcttgcagataaggttggcgaccttggtagaagccgcttcccggctggtaagcgtggcataggtaatacatgcgtccgtccggtgttgtcgtaatcgttccgtgaccgatggagagaacctccttgcttccgtgcaagatcgggtttccttggtatttctcgtaaggaccttccagctttttcgagcgagccacggatacggcgtaatcgctctgcgggccgcaacagcctctcacggagtagatgatatagtaatatccgtctttcttgaaccaatgctgaccttccataccttgacgctcatcgtcacgcagcaggctgaaaggctttccgtctaggcgaagcccatcgtccgtcaacttacaggccaataactctatgggttggttatccaatccataagccttccaactgatgtaaagtttgcctttgtcctccaagataaatgcgtctatcgcttccttcccaaactctaccaccgggccgtaatccttgaacttgcccgtaggtgaatccgccacggcgacaccgatgcacgagatgttatccgattgcttccgggccgtataatagacatataccttccctttatgctgataccattccggagcccagaatgaggatttagtccattccggtttctcgtcgaatacatgtccggtttgctgccagttcaccaaatcggtagaggtgaaaaccggataataaggggcccattccgaggaggtgccagtgatatagtaagtctggtcgatccggataatggaaggatcggctacgtcaccgtggatcacgggattggtaaaataggattcttgttgcgctagtcctgtggccaaggaggcggcacagaagaatagtgtgaaaatctttctcatgttttatcgtattttttttaagatgttcttacgtacggttcgcaaagagatttgtagtaaatcgggttccgccagatcgagtagtgtcttatattcctgtagcaactcgggtatgggacggcataactcatatcccagtttcatgcaaagcgtttgcacaccgggtaattccttcgctgaaagcatccggtccaggcagaagttcaggaaatctactcgtgggggattcgtctggggttgtcgtacaagcaagttcaagagaatgcgtcgctttccggagtgctcacagttaagcacctcatttatcagctcatcctgtttatcatatagccattcgttttccttggtcgagaaatggctacagacccataacgcttgataactaacggcatcatccggatcgaatatcagatcgtatagctctgctttccgttcttggttcccttgtacataaaataatatctcatggatatcctctatatgacagcggcttgatagtctctcttttaggtccattctcaatctttgttgttgtctctttatcttttctgccgtaaagttatagtctttttagcaaagtttccttagttcgcttacttttgtgccccattgataaaagaatggatagatatgcgatatatgaatttattaaatgatttaacaattgattgtaaaaataacggagggtgttaccgagtaaaggatcagttgaagaaggttaagtatttattaaaatagtatctttgctccacaagaaacagtcttggggcgaatggtgacggttggcttgcgttgtgatttgtttttaaattagtatctttgatccattggaaacagctctcctaccaaggtgatacccctgatcagcgttgtgatttgctttcaaattagtatctttgatccattggaaacagcgcttcgatggcacgttcggcccaaaggttgttgtgatttgctttcaaattagtatctttgatccattggaaacagctggctttgatttagtactaaatgatcaaacgttgtgatttgctttcaaattagtatctttgatccattggaaacagcttaatatatttgtcaaaactgccatcactcgttgtgatttgctttcaaattagtatctttgatccattggaaacagccaaacgagaaagatctaaattgagttttgtgttgtgatttgctttcaaattagtatctttgatccattggaaacagcgttgacaaatatactgaaatattgattatgttgtgatttgctttcaaattagtatctttgatccattggaaacagcaacgcctgttgaaatatcacattaggtaatgttgtgatttgctttcaaattagtatctttgatccattggaaacagcggaactataagctggatacgatccgcaagagttgtgatttgctttcaaattagtatctttgatccattggaaacagcctttggtaatgatagcgtaataatgctgatgttgtgatttgctttcaaattagtatctttgatccattggaaacagctattgtttattttatagttgttgtatatctgttgtgatttgctttcaaattagtatctttgatccattggaaacagcaaaagaaaaaatgaagctcctccgggagctgttgtgatttgctttcaaattagtatctttgatccattggaaacagcgacaggacaaaatttcttttcccatacggagttgtgatttgctttcaaattagtatctttgatccattggaaacagcattaactctatcgaaggatgctacaaaggcgttgtgatttgctttcaaattagtatctttgatccattggaaacagccacctacagcacccgaaatgccttgaacatgttgtgatttgctttcaaattagtatctttgatccattggaaacagcttcggctgtaaatgagttgcttaggcttacgttgtgatttgctttcaaattagtatctttgatccattggaaacagcagtcttctgcattaggtcaagcacgcaaatgttgtgatttgctttcaaattagtatctttgatccattggaaacagcttgaaggtacacgccttgcagttcatgagagttgtgatttgctttcaaattagtatctttgatccattggaaacagcgctataaacgcaaccgtcgtgtccttacgtgttgtgatttgctttcaaattagtatctttgatccattggaaacagcacaaacgcttgggactatcgagaagatggtgttgtgatttgctttcaaattagtatctttgatccattggaaacagcccgtgtacgatatacatgctactactgttagttgtgatttgctttcaaattagtatctttgatccattggaaacagcttaatctgtattatatgctgtatatcaactagatgatagaatggttagaaaataaaaaagaaaagtttccaatgtaataaatcccgttttatgacgggatttattatttctagaaaagctctaattgttggccgggtgtattaggaggttgtacttttttcccatagaacaactcaatattcccaaattgtttgtctgtaatgcacattattcctatttgcccgtgttctggtaaaaatgattttactcgttttatgtgtacttctgcattttcttggctggcgcaatgtcgcacataaatagagaactgaaacatggtaaagccatcacgctgcagattcttacggaaatcactataagctttcttttctttttttgtttccgtaggcaagtcaaataataccaacacccacataatacgatattcgctaaatcgatccatgattattaccgttctggatacacgattcttcgttgctctccactgaaacatttgtaaagagaggctgttgtttgagcgacagcgatcattaacggacttcgtttacctccaatcttaacttctaatgtaggaatagaaagaagtgatgctttccattcttttgttaatatttcgggtgatataccctttgttcttatcaaaccaaatacaagctcatcaacataaggtctataaggttccatgatgtcatcggctaaacaataagcattatatcggttatggtgatgaatacccaatgtgggtaacataccacttgtgactagtccacgtgcaacaatagcacgaaggatagcataaccataatttaataaattattaggaggtataccttcccgatctcttgtaaaaccttctatgtgtccgaacagatacttccaataataagcagctgcacgtccttccaaattgtcaggatctccactacgtacatcattggcccatatccgcatacattttatttcttcgtttttacaagagcataatactgatgcttgattgttgattttcgcttgaatagtctgttgccaaagttgtttctttaaaggtaaggaagcgtctaattgatctcgaaagcgctcattttgtgtcgtgtttccataaagcggaagcatgaggcctactggcatacttcgtccatcacatgtaataactgcgcaattattctctagtaatgcttccaatacaccctgggtaatagtaatttgtttgttgtcaagaactatcactgcaatatcttcaattggtttagtaatttctgattgtcgtttgaagctttcgggcacagtatcattctttactatctccggtaacttaataactaattgctggttacgaagtgacaggtaagctggattaccaaaataaaatgttttcttaatcataggataaaatctaattagttagtatacatgaacctacttgaattatatttcctaatctatcaactttaatgggaaaacatatttctttaaccatttcacctgttatagctttttgatttttagattgaggactaccaataccatattcattctgaatgcaattttcaccattacaatagatttctgcagtagctttaggtaaagcaaaaatcaaattggctgttgaagctgggatgaaattagcggtaatgccacttgagtcaaccattttgtatattcgatccctatctatcggcattacgacttcccccttattaatctcctcctgtgtcggtacatataccagatcattaggagagagtatatatttaggtagattaccattctcatcttcaggagccgaggaaagtccctgcttttggcgttcgatcactacatttaagggaatcgtgctataacttcttttacggattacttttttcgtatccttatcaatctcttctgtttcatagatagcaaagaacaggttggttccttttgctgcctctacaaatttagttcgcttattccctttttgtcctacagtaaacttttcagctttttcgtagacacgcactttataaatgggctgatgcttttttcctttattcaatataagaatattacggttcatttcatcaataccatctggagagaatgccaatgtgggatcattgtctttagtttccaaatgtcgaagcataatttgttggatacctgtatctgtaatgctttcctttatcttctttttgtcgaaactagtatctataggcttccgcaccgcaaaatagcggtctttcgtctcttttgtaaagtaatagactttgatttttgatggattaatatcttgccaagtatctttattttcctcgaaatagttctttattcttttagtgtcatagcctaactcgagcatagcgagtattttcttcttcaagtccatttctactattgcctgtggtttctttaaggcctcattaaatgatacggtttttatcatacgcaaatttacttctccgtgaaccgtttccttatgcattgatttacggatagcccaactatccccttttgattggttggagactatcttctttccattttcataatgctgatagtggtttgttgtcttgttgatcacacgcaaattttgcttaaagctaaccgttattttctgcaaagctgtcaatgtatcttgagtgaatgtttcccaaggcttgtcaataacccatttgtaattaccgttattatcagtcttgtccttgtgacataatagggtttgcaaatctcgccgtgttatctttgtgtttttactagccgacacattattgagatagttcacgatgttacgatttgcgcatgcaatgataatggcatccatcgcatgatggcggtgatcaatacgttttttattgaatcccttttgtaactctaagggcatggaggggatcattgtattattggtattgatagaagtgaaacgggtactttcagtcagttcattcaaccgaatgaaacgaggaagtacaatcttattccaaacatcgttgatgccccaatccttttttaatcgatcggtaatacctcctgtacaaggaatgacattcttggagatagcctcttgctcgttttcttcacgcactatattagaaagcagagattttactactttactaatatagcggctgtcgttgagttgccgttctataaattgatctggaatatcttccatgagtaactttttcattttacttctgttatgtgaataagattcatgcacaagtttttcataggcttccacggaaagtacctcaacaggcttgtcaaaagctaattccaccttttctccatgatggtttttaataaactcatagccgaggctcctatccttcaatttatttatctcagattcacagatcaccttgttgctaagtgaatcatcgaaataacgtgattgaggaataatatgttctatttcataagcaggagtgaataatttacttaatggtatcatttcgcctgtataaggtgaacgatatttttgctccaaccatagtttgtaacgtagtatttccgagcgtgttggacgttttagagtatctgtttggttgaattttcctaatataattcctatatcttccggtaattctaatatactatttagtacgccttcttcataaatacgcaataaatcctgctggctgggggaatatggacgtacattctctattccaaattccggattcaaaaattcagtcaatagtgcttttatgcgtaaattggtattctcgttctttatcatttgttgtgacatccgggcacgcttgtccgccggatttttcatttcccgtcctaattcaatatgtatctcatcgatatggcctacttgttgccaaatatctcgtacggtacgcaaggtttccgttatcacttgctccacgattgggttgcgtaacgaatgttgtttaaacgattttaaatagagatctatatccttgggagtcttccatttaactatatccttgacttcggagtgacgatcgtaaactagataacaagctaaccataaaggcaaagctcgaaaatgggtaatatcagttaggttaatagctttttgtctaactctctcacgaatgttctcgtcatactctccatctataattttattaattcgtattcttgtcccattatctatgttttcgatactccaatatttacccattcgcatcaatggaagcaatttctttatcgccttagccgagtaagagccatattccttcttgaaaggagggaaattcttgaattgttcaataaactcttcgcttaggttattcttattggcaaaagagtgtaaggctttttctatttcttgtttatcttctatggaatataatatatgccataatgtctcttccttttccttagaaagaaaagcttttgggatatgcgcttttcctaaacgagctattatttgtgcatgggtttcattacagggataaggtttatcttccacataattccaacgatagtttgaagttgttttcttaaagccgaatggcgggtatttaaaaaaggctttttgatcgatttctttcttttcattcagccactcaaataaagtgacataatcagcctcggtagggagtaattcttgtgttacgtcaacatccgtttccttcctgtagatacgtaggtttacaataaattgccaaaggcgaaattcttgatagagaggatgagacttggctatacatttaatggatgcatgtttgatttctccactctctttatcaatatacctattttcctcatagggacaattgtcgatcaatgatttcttgctcttcagtggacgttgatagaaaatgatatcttctataaataaatgacagaaatctcgtgtggaaatactattcctacgtggttcgttattgggataaagctcattaaggcaagcaatatataactgtttatctcgtaattcctcatgaaattcactttgggtctttagtatttgatagagttcgtttttatagtatttacgttcgatagtacgtactagcttcccacgtattttctggtctggtttttgcagaagtgtatcataaatataagcgccgacagtcatcttgatcttgtcgatatctgcttccgtcttctttttaattaatgtccaatcatcatcttttggcgcacggaaagaacgctttatatttccttccttatctttcttaggactaccatcagcctctagatcagtggtgactataaattctttagttttaccttcccaatccaatggtatattacttgtgcgccggtaaatcatcccattctccaaatgtacgttataccaggtgtccttgccttttctctctcccgagtcttcgactttttctactttcaatgaataatattctactagtttatttggagtttcctcctcttcacctcgaagttgatagtatcctcgtttctgattaaagttcaaaagaatccaagcgagttcctcttttgatattttttgtgttaatgctttctttctaaggtaatagatcgtccaatcgtagggtacttttttgttgtttgcgataagtatgggatgatgttcggtaaaattggccaacatctctttaaaagactcctgaaagataaatttgtaagaacctgtttcgtcttttacccaaggtaatttacattctatgtcatttaagaatttgccatagcgattgagagaatcggaataatgctttggtaaaaagccgagtaaatcgagaattctatgcaggcgctcacgtcttaatagatggcgttcacgcaatctacgtataccacgatagcttgttcgatccgcagtttgtgagatagaatttcccttatcgaaatttcctaaaatggctgcgtccataggtataatacgactgccacaagcttctataccatataagtgttctttattatattcatctatataagcattgattaatgcccatcctatactatttgtacctaaatctaatcctactatttttttcatgactagtattgtgttaacgattttttcaaagataaaataaattatcaagaaatacttgctttataaatatattctttatttctttgctatactaatttgaagcaaatcacaataaggattattccgttgtgaaaacatttaggttctagcccatcgtcctttatcggtgggctttttttatgtgtaactagtcctgttttttgataagaatgccttcgttaggctacgcatatagtcatgataggctacacgattaccttaaatttttaaggaagtgtagcttgaagatgaagtatcgggaatggcttgttggaggaatccgtctcgtctcttcctatcacttggaatcccagatgctgatagaaatgaagtgcggttgtgttttgctcatttacgtcgacttttcggatgggtgtctcttgcaaggcgaattggataagtcgtttacctaatcctttgccttgctcttccggatgtacgaaaagcatctcgataagctcatcgcttaagcccatgaaggcggcgatctttcctcgctcatttcggatgatataaagttctaccaatgggaaatatccgggaacaagttctttataaaataagatatcctcttcttttaggaaatgatgggtactacgtacggacgcttcccaaagcagaagaagctcattgaagtcctcgaaggagggacgggttatcgttcgcttcatcggggtgtacttcatcccatgtgtagtttgttcttcgcagattggttcgaacccgaatttccggtagattgggattgcataggaagaggagttgactgtcatttccgagactggcttatcttggatagcggcctcgaataatcgtttgccgataccttttccatgatacataggcgtgatgaagaataaggagatatgctttccttcattttttgtcgcgattagacctattaatgactcaccctcgaatgctccgtaaatggttagctcatttaccagatccttattgtaaatgaaactcttgaaggttttcaatccctcttcgtcgaagtcattcttgccacattggatgaacacgtccaaagacaaggttaatgccttatcgtattcgtttacctgtaattgtcttatttgcataaatggattataagtctttgttcccaactaatttctcatccgctacgatctcaaaatgatgcgcatcgatgaatcgtccgtttttgtaacaagcttttcggaagatgccagtcttcttgaatcccactttctctaatacccgcatggatgccagattatattcatacaccgtggcgaatatacgaataacctccgtatgctcaaaataatactggatcgcatcggctaacgcttcagaggtaatcccttggttccaatatctctcactgatccaataaccgacttccgcattgaaacgttccacatccgttcctctcacaaaacctatattgccgattgcctcaccatgaaccacaatgcagaaatccgatatttcagttttttctcgtgcttggctgatgaagcagcgggcattttcttttgtataaggatgaggcaatccatcccgacagttatcccagatcttcttgttattaaggtgcaaggttaaggattccgtatcttgaccttcccaactcctgagcgtatataaatcttttgttactactatcataaactattgtttttgtttgaaaaggaatgatggtcaagataatagcacaaatgatcctctatttgtccagtatgcattagctctgcttgatgaagccgtccttcgtatacgaatccattcttctctaatacacgttgtgagcgttgattgtgaggataacaatttgccgtgatcaaatgtaaatccatttgagtaaatccgtaattcaatacggattgcactgcttctgtcgtgaagccttgtccccaacactcttcttttagccaataacccagcatgcgagcatgtgggttttctcttttgggatcaggaatgatgccaatggagccaatgacttgttgagtctcttttgatacgatagcccaaaccccttcttttccgataaatatggtatttagtacatcaatagtctcttcgatcgtttcgagaggtttccatccggcgttattgcctaggtttggattcttacagctctcaaaaacatcaggagcatcgctttcgctgaaaggacggagcacaagacggttggtttctatgttcgatgtttgtgtcatatacggatgtttatttagtcgagatagatcattttcttggtcatcccaccgtcaatcgtaatattctcgccattaatgaaatcgttttcctcttgacaaagaaataagcacatacgggcgatatcctccggctttcccacccttccggacggatgttgagcatgatcctccggacgaagctggtcgtaattgttattctgtatccaaccgggagcgatagagtttaccgtgatatgccattccgagagcgataaggccaacgcatgcgtcaaagaatagatacctcctttagaggcggcgtaaccctcgctaccgggttcactcatcaagtaacgggtagagcagatgttgataatcctgccgtatggattgggggtatcgagagattgccgatggagcgctaattggcgggaggtgataaacgccgggcgtaagtttatggatagtatcttgtcgaaatcctctacgcttgtttccgtgatgggagagaactgactgacacctgcgttgttgataatgatatcaatatctccccactcctcgatgatctttcgcaggcaatcttctagtgcggttttatcgctaacgtccacgggaaagaattgagttccggtttgtaatgcggtctcttttcctgatgcttcgtttttatcacagaacgctactcgatggccggctcccctgaacgttctcacgatggcttttccgatcccctcggccccaccggtaatgaagactcttcttgttttatggagtgtcttcgtattgtgactggttcttgtcccggaggttttccggacttgatattgctcgtattttttttccaaatagttgtctgccatgatccattattagttgaaagaacaaatatagtgtttaactaaataggttgtgcgcttgtttataaggtaaagatcatttagaatcatgaaaatagcgatcagcggtgcgagtggatacataggccagcatcttactctttttttcacggagaagggtgatgaggtggttcctttaggaaggaacctgttcaaggaggagaatttcgatgagctatgccatcgtgtggaatcgtgtgatgtggtcattaatctggcgggtgcttccatcaataagcgctggacaaaagcgtataaacaagaattatatgatagtagaatccggacaacccatcagttggtaaatgccataaatacccgggatattttcccaaagttgtttatatcaacttctgccgtaggctattatcccacatccggagaatatgacgaatataacaatcggcaaggtgaggatttcttggcccggttatgtggcgcatgggaaaaggaagcgcgggcgtgtttgccggatgtgcggcttgtgattgcccggttcggggtcgtactctcggaggatggcggggcattgagacagatgcttcatttgcaacgtctctcccggataggtgtggtgataggcgatggccaacagagttttccgtggatcagcgtgcatgatttgtgccgctcttttgattttatgatacaaaatagtacgttgagaggagtggtcaatcttgtctctccgcaatgtattacccaaaagcaactggcatatgcgctggcgagagcagatggaatccgttgggttatgcctttgcctacattcattttccgactgatgttcggtgaaggggcttcgtttgtaacgaaggggcaaacggttcatcccacgaaattattggagtctggttttacatatgattatccgacaatagaaaagcttatgaatataacagatcatcgtaccgtgcaggcactggatgtccgccggtatatgggacggtggtatgagatcgcccgttacgagaatcatttcgagaaaggtatgacggatgttacggctacttatacattgcgatcggatggaagaatccgtgtggaaaacgagggggttaaagatggaatccataaaaaagcagtaggccgggcgaaacagccggaaccagaaaatagtccgggtaaattgaaagtcgctttctttttgtggttctattcagattattatatcttcgaactcgacgaacattatcagtatgttgtggtaggcagcagttctgacaagtatctctggattttgagtcgtgataaatccttgccggaagcggttatggaagatttgcttggcaagataatgaaacgaggatatgatatctctaaattggtttataacagaatttgattacatagtttccaaaattagtattgatagtaatctaggctactatcaatactaattgctattaccctgtcatttatttcaattgttttccatcagcaaaggcatttcctaccttttcgcccactctcaaatagtcgttgttgaatggatcaaagatgatgggagcggctttagctacattcaccttgccgttctcatcaagtacacgctcgtcaacactgacatttacgatctcgccacggagtatgcaagtatccggatcgtaatctttcaatttacattcgatagccacggccaattcgtcgatcaacggagcatctacgaagtctgattttgtagcgtgaaatcctgctttggcaaacttgtcggtaactttattgcccgacacgatacctacataatcacaagctacgacatgatcggcatctgccatgcttaccgtgaaagctctacgcttcaggatattcttaactgtcttgtgaccggcgctaagacacatgctgatctcattcatctcactgataccgccccaagcggcgttcatcgcaccgggagttccatcttctccatacgtggcgataataaatacgggttgcggatagctcaaaggcttcgcaccaaaattctttctcataatcatttattttttagtccaattcttgatatcttcttctgtcgctccgttcatcaacttccctttttgccagttcacatccggataggctttccgcaattcactctctgcgttcgagatattgctgctgcctgatgtggcgaatgggatagcggttttgcccgagagattgtatttttccaaaaaggtgttgatgagtcttggggcttgattccaccagatgggaaatcctaggtaaacggtgtcatactccgctaggttcttcaaatcatcgataatggccggtcgtgatgtcggatcgtccatctctacgctgctgcgtgaggatttatcccgccagttcagatcggcggaggtatagcttttctcaggttggatcttgtgaagatcaccactgacaatagacgcgacttgttgggccgctttttcagtatttcccgttgccgagaagtaagccactaaaacttttgtcccttcggcagccttttgcgcataagaggcgatacataccattgagaccatgaccatgaataatacgattcgtttcatacttcttgaatttttgttgtttttatattcattacgagaatgctatgtatttatggcgataaagataggagagaaaaatgaaacagtttgtacccaaattactgatatatctgatatttttggcgatacgatccttatctttgtaaggcgattaactaaaagaagaaaatatcatgctagcgtacacttatattgaacaagggaaatttgaattgcgggagaaaccgatgccggaaataaaggattcacgggacactatcgtacgagtgactttgggtagcatttgttctagcgatcttcatattaaacacggtagcgtaccacgtgcggtatccggaataaccgttgggcatgagatggttggtgtggtggaaaaggtgggtgccgatgttactgcagtcaagccgggtgacagggtgaccgtgaatgtcgagaccttttgcggagagtgtttcttctgccggcgtggatatgtcaataattgtaccgatcccaatggcggttgggcgttgggctgtcgtatcgatggggggcaggcggagtatgtccgggttccttatgcggatcgaggcttgaatcgtatcccagatacggttagcgatgagcaggctttgctggtcggtgatgtgttagcgacaggtttttgggctgcccgcatctcggaggtctcagaggaggatacggttctcattattggcgctggtcctacggggatctgtactttgttgtgcgtgttgttgaagaagccacgacgtattattgtttgcgagaagtctccggaaagggcccggttcgttcgccagcgttatccggaagtcttggtggcagatcccgaaaactgtaaggaatttgttcttcgtaacagcgatcatggcggtgcggatgtcgtattggaggttgcggggagtgaggataccttccgcttggcatgggattgtgcccgtccgaacgccattgtcaccatcgtagccctctatgataaacctcagcttcttcctttgccagacatgtatggcaagaacttgactttcaagactggtggggtggatggctgcgattgcgccgagattcttaacctaatagaagaaggtaagatagacacgacgcctcttattacccataagtttccattgaacgagatcgaggaggcttaccgtatcttcgaaaacaggttggatggggttataaaggtggcgattgaggggaatctcatcaaacctgtctttgttttgccgcatacaccttgattctctcctcgcaacattgtcgcgtgatatcccggagccgttctactttgggtataagcgcctcgatatcttctttagtgacgcggaagtgtaaattataacgagcttgaacgtatgcgtcctgcagcaaatcgaaaagtcgtttttcttcttccgtatcccggggaaaggcttcggatgactctagggaatgcgttttggctctgccggataacgttattaggctatgctctttgggactatacaatgtaaaagtcaagattatgctgttgtaataattctcacaagcttgatgcaaatgaaaagaacatattttatatctctcgtcgtttttgtcatacattgcatttcgtaaaaaatcattcgcacgttcaaacctgtcgttgtaatactcctccgccaactcttttatctcccgatagttcagtttacgacggcgggccaacttataacggccgctgttgtaaagcatgataccttctcgcttgatatcggtatagaaatatcggtttttatcgatggctttattcaagtcgtcgatgctttcgtctataaattgtacggtggtggatgcgtatctgttcttccctttgtagtaattatcggtggccttgctcaagatgtgattgataatatatctttggaaacgggtactggtaactaccaaaatatcataatcgctcataaaacaggtgcggataccgtattcgatgcgttggtcgtagtcaacgtatgtattccgggcataacttccgtagagaatgatcatctcacaatcgggaagtacttccagtacgcactctacaattcttctgaggtcatcccgtttctgttcgggaaggtaattgatggatgttttcattcttcgtttatctatgcaaattgtttgtaatcactttttactttcaatgaacattgttctgtcccgatagcctttacgatagctaaaagcggtgcgctgaactgttcggttagcttgttcggtacttgttcggtcgacttgttcggttggctgttgtggggtattgatgatgaatgttaccctcactaccacggatgtatgattcgaaatctatgtccatatgtatccaatcatgattataaataggcaataaagatataaaatatcctgctatgtgatagtgaaaagatgaagaagttgtattggctcggtcttttacgtattatgagtttcctgtaacattgaatttataaaaatatctacaatatctaccactctattgtgtactctctgtaaataagaatattacctataggttgtagatctccaaacatctacaattattattcaatatctaccacttattattgattttcatgtgtttttctttgcgggtaaagagaaaaagtgttatatttgaagaatactgaaaatctaaaagatatgatagaaaaactcgattacgctatggtgccgacaggctttgtacattgttttaatgaaaattgtaagaacgccaaccgctgcttgcggcatcaaattgtccgttttatccccgatacgctttgggcggtgagcatcgtgaatcccgcacgtaccagtcctaccggaaagtgtgcggctttcatggcggatactcccgtgcaatacgctgtcggcatggatcacctattagaccagataccttatctggaggcgaaacgcatcaagcaacgtctgttgatgacatacggtaagaataagttttatcagtttaagcgcaaggaaagaaccttctcgcccgaagaccaacagtatatccgtcaggtctttcgggcgtacggagtagaggatgaaccagtctttgatgcttggcagagtggctaccgatggacgaagggataagagctgataagagtttcccttaggagaacaaatagtttctcttagggaaaacaaaagtttctcctagaggaaacaaaagtttctttaggaagaaacaaaagttttattaggggaaaacttttgtttttctataggaaaaactgtaagcataagttattcaacttcttaaataatatattagacatgaaaataaccaagcaaacagcctatcgacataccgtcgcgcaacgggcgatgcgtatggaggagatcgtggcatgggtaaaggatgagcggacgagggataagcttgcgctctttcgagagaaattaaggcgggcttatcccgacaaacggtatccgtttacccggaaattacctcagttgctctttgccggaacttttcgaaaaggcgagttgaaggagtataatggctggattttgctggagatcaatcgattgaagagcatagaagaggctttgtccttgaaacaaaaaatagtggaatatccgcagacactgttcgctatgatcggctctagcggacggagcgtgaagttcgtggtggcttatacctatcccgacgggtcgcttccccgttcgcgtacggatgccgaggtttttcatgcgcacgcttaccgacatgcgctcaagacgtatgagcctcgcctttcttatcccatcgagctgaaacgtccggtgctggagatgggctgccgcctcagttatgatgccgatgtgtattacaatccggacgctctttccattcatctggagcagcctgtggctatgcccgacgaaagcgcctaccaggaacggttcgaaaaacgggtgccggtaccggtagagagtgccggacagacgctttatgaccaataccgttacgttgccatccaatatgaattcgctttgcagcgggctttggaggaacatggaagtttgagcataaaggtggacttcaaacctttgttggtcactcttggaagactttgtttcgcggctggggtggaagaggaggattgtgtgaagtggacgatgctctatctggggaatctgatttcggaagtggagatccgggagaccttgaggcagtcttaccgcttagcctccgattctgattttggcagtacgtccctttacaagccggagcagctacagagcttgaaaatggaggagtttatgaaccgtcgttacgatttccggtacaatctgatgtccggcggaccggaatatcgggagaaaaacaccttctgtttcgactatcgccccgtgacggatcgtgtgttgaacagtatcgccttgaatgcccagaaagaaggattgcagctatgggacagggatgtacggcgttttgtcttttcagatcgcatcccggactatgcgcctatcgaggactatttgacccgcttgcccgtgtgggatggcaaggatcgcatccgtccgctggccgcacgcatcccttgcgacaacgtacggtgggaacagttgttttacacttggttcctgtcgatggtagcgcactggcagggacgtgacaaacagcatggcaacagtctttccccgctcttggtgggcgggcaggggtgcgggaagtccacgttctgcttcaacctgttgccaccggacttaaataagtattacacggacagcatcgatttcagcaagaagcgggatgccgagctgtatcttacccgtttcggattgatcaatattgatgagttcgaccaagtgagcgcgaggcatcaaggcttcttgaagcatctgttgcagaagccggtcgtaaatgtgcgcaagcctcatgctacgcaggtggaatcggtgaaacgttacgcttcctttatcgctacgagcaaccatacggatttgctgggcgatccttccggcagccgccgtttcatttgtatcgaggtgaaagggatgatagacaatgcccagcctatcgattatctccagctctatgcgcaagcggttgccgccttgaataataacgagcgttattggctgacgcatgaggaagaggtctcgcagatgcaagcgaacgaggcgtttcaacaacgtcctttgttcgaggatctgttttttcaatattatcgtcccgcttcgcacaaggaggaaggtttgaagatctctgccggagagatctacctatcgctgcaaaaaaagagcggcgtaaaacttccgatgagcaatgtctccgtctttggtcgcttcttgaaaaagatagggctaatgacacagttggcgagtaggggacggttgtatttagtggttgaaaagtagtaaatggtggtagatgtaagttgttggtggtagatgttttattatctaccaccattagataagtgatttatagatagggacttttaagggtaatggtagatgtggtagatgatttcgtattatttaaattcatacacatcttatgggatacatccccggctttcagctataaaccgcgataataatttatcccacttctgaatcttcccaaacacctgttttgttcattcgatagcttctctctatcttttgggaagagtctgcctccagcgcatagagtatttcacgacagaactccagagttgcaaatccgttggcggtaataatgtttccggctctgacagccagttcatccatataaagattttcacctgtataattaacccccgcaaattgtttgaggtaatccaatccgttgctggtatgatttacatggttcaagaaaccgtgcctgccaagaaagacggaggcgttacaaattccggccaccagcctcttcttctcgatggcctcttttaccagaggaacaatggcttcggcttccggggtgaaccagctcatgccacctattaatacgatccctgcataatcggtcggaatgtcatggatcccatagtcgggcagcaccttgaaccctccgatcgatacaaccggctctttcctgacagatacggttttaactatatatttgctttcacttccgggctcaacacctaaattgaggttgggagcgatataagccccttcccaatcggcaaagtcttttaacaagacgaatagaatttcttttttcattatttattgtatttatcgaagttatacttctttctaatctcgttttgctcgtcaggcgaaagagatttgaaatatcctttccagcctgggcagaagtttatgtgccaacgccaaaagcgtcccattaatgactgagggcttttatcgtattttttccttagggggcagttgttgcagttacttttttgcatggatgttacagaatgcttgttgtttacaaaggtaatgcttttattggaattgctttatttcaatctttgtttattatgataatataccccatctgatataattgccaatatttatcgtaattttgcattattcgtgaagatggtagttgttatgagcatcctcattggtttgaattggcaaaggataaatgggcgcaggtttataaaactacgggaactccatgtagttgttggatgtgtagaggggaggagtacgaccgcaaaggatataagcaagagactttgcgtattatcaaagaatcagaatattagatgtttaatgaaaaggaagaaaagatgttgaaaggtaaaacaattcttgatggtttgtaagtgtttaatagagccgtacaccgttataggctcaaaaatcttacaaacaatgagtagaagtagaaaagtaaccttatgagaaaagttagaaagaatacagcaactagacaggtcattcatattgtcggtgaaggattgactgaattattctatttcaaccatttgaaaaagttgcttggttataggtactctatttctccacgtctgtttgacaataatagtgttataaagctatcaaaaagttagcgaatagttaattggttctcaagaaaattcagtatttttgcactcacaattgaataaaaacaattagcaaattacaatgctgcagaatagagtgaacatattagtaaacacgttatgtcgaagcacagtatgctttgagcgtatgccgtatgttcatactttaggcattgagtcattcggtaaattcaaaaacactttccagcgaacgttttatagacaggtaggagtacattagatgcaggtattcctattaaaaagataaattgaagccgttgaaaagtccttactaaatttttcaacggctttgtttttgcccattggtgacgttcgcattatgtgctctactccgtcatttccgtccatgggcattgaaaacttcagttttattaaccagcgcagtgatgtgcataaaaaaagaagattatggattacaaattcaacggaagcggggtgttctttacatccgatacccacttcaatcataccaatatcatcaggttctgtagcagaccattcaaggatgtagaacacatgaatgaaacacttattgccaactggaaccgtgtggtcggtccggataatatcgtatttcatcttggcgacttctgtcttggtggctctgctgaatggacaaagatactcaaaaggttgaatgggaaaatctatctcatagccggtaatcatgacatgaagaacttgaggcagaattatacaaaatatttcgaactgatcacgatgcagatgtacattgaggtcgataaacagaagatttatctgaatcattgcccgttcctttgctatagcggctcatacgatgatacctggcagcttttcggccatgtgcatacaagcaggaataacaccggaaaagataagcctcgccttcaaatgcttttctctacacagtatgatgtgggagttgacaataacgacttcactccggtttcattcgcacgggtaaaggcaatcatagagaaacaggttgaactatcaaagaaatgagaatacaatacatgagtgatctgcacctatgcccacttttcaggtagttgcaccttgtcacaaagatttggtgctgaacagtgcctttgcgagtgactatggggacttgataagcaacaaccggattgatgtctggatatacggtcattcacatacgaatattgatgcagagattggtggaaccaaagtattatccaatcagatgggatatgttttccagaacgagcatcttatgaatgggtttgattcgggaaagtatattgaaatttactaagaatgaagatatgaacgaaaataagataatagatagaaagttctttgccgatttggctgaagaatatgccttgaatacctctcattttgaatggttgggcggggtgcgtcatccggagattgttgttaagggtgatatgttggacaggctgattgaactccagtcccagtttaaaagattggaagtgatgggtgatattcaacccgatggaaacacgctggtttcatgtcgcttcttccatatacatggagcgaagggcaatccggtttacagaccggaaatatacccgtttcgttgtttcaaattattcttcgtatgtttcggataataatgaatactataacgatgaatggagcagggaaactattacccgtatttttgcctatctgcgcagactggtggatgccattattagtgtatgagtcgttctacagaaatttgcctgtcagtaaatacaaccagactgaacagacttatggccctaatgaattgcatgacgtaacttattataatcggatgaagtttgcaaaaattgatgagcagtacgatattgatagtccggatgatttcatctggtttgccaaggatcattatggagaactggggctttccttcctgaatatctttgcatcagatacagaacggtcaggatgggtgattgtcgtttccaacagttattctgcgaatgccggtctcgccattgaagttgccacagctctgtataagtccggtgttccattaataatctacgatgccgacaagcttctgaagattcttgaggaagaagattatgtcaggttggttccttattcataccataactatatgggctatcaggaggaaggctccgtttatgagctaccgtgggaatacgaatgtagtgaagatagtggatcatctctgactgctgagcaatacaaagagattgtctcgtttgctgaatggcaggaagaggagagggtgaaggtaaactaatgtcatatttcatatgttaacgcacatctggcaatccgtttggttagtcagtaacatgcaaattatcggcactgattcgaaatagtaccgataatttgcataattctgatatttcaaatatgacttaatcaaattctaactaacaggcattgttcgatgcaatagaattccctacgatagatgaaagaataagaaatctttctaatatgatggattggatgagatatcttccatcagtttcattaggtggagatcaagaatcgtattcaataacgaaataataagttgtagagtaatggtgtaagattctattagcatatcgaggataatttcaataaacttggagttcgttgataacaacttctagagttgctgaaataattaacgaggatatttttctaacattctaaacggaatatcatttgtagtaactttatctatagatattttgtttatatttagctgtatatcattattataacatttgtatgtattcacaaataagagatccaaacagctttatgaaatgataattgtctatgattttgcctaatttgataggaataagtcttcaaattacattgagggacataaatttgtctcccgtgtgcgacttgaggggcaaatgggggacaaaaaactgaaaaaataattataacaagagaaaatacgagtgaaaaaagaaaatggagtaatgctttgaagtgactgatttaactcattttacgactttatattttctctttttatgattttgttttcatttggttatttgccgatgcaaaaagtgtaacaaagttgaattattcgcttgaaaaagtgtaaaactatatgtgttgtacttgttttagccttaatattaacgtctcaaccttccttgaattataccccatttgatataattgtagtggcgaaacaataaattatacccatactgatataatatcgaatatttgtgctaactttgtacccgaaaaggtataaagtatgatgctatgaatattctttctactacggttaaaatgttgcgaaagcaatataatctgacgcaagaagagctttcgttgaagtcgggtgtggggttgcgctttgtgcgagaccttgaacaaggaaaggaaacgctacgtctcgataaagtgaaccagctccttgactttttcaattatgaaatggttgccactcaaaaaaacagtaatcaatgagacaagcccatatattttacaaagaccaattggcaggtattctgactgaaaacgatgccggatatgagttccgctatttgccggaatatctttctcttgaaaaggcaaaggaggttagcatgacattgcctttgcaggaggaagcatatacaagtcctgtgctatttccatttttcgacggtttgattccagaaggatggttgttggatgttgcattgcggaatacagacatcagtattcttgaccggatggcgttgttgctgacatgttgcaaggattgtatcggagcagtaagcgtcattcctttggaagaaaaggagggaagccatgtgtaattgcttatattgttatcgtccgctcttaaaaggggaaaaggacatgcacacggcttgcataaagaagtttttcggaacagcaacattgccacttcttgattatacgacagaacaacttgatcagcttgctctgcaaatcattcaagaacaaacctctttgaccggtgttcagccgaaattatccttgcatttgaaggaacatgagggctgtaaaagattgactattgtcgggctatggggcggttatatttgtaaaccacagacctcgcaatatgaaatgatgcctgaggttgaggatttaaccatgcaccttgcagaggtggcacgtattgaggtcgttcctcatacgctgatgcggatggcagatgatacgctatgctatcttacccgccggattgacaggacttctgccggagagaagatagcgatggaagatatgtgccaactgacagaaaggcaaacagaacacaaatacaaaagtagttatgaacgtgtcggcaaggctgttttgaaatactcgtctttacctaaaatggatgttaccaatttcttcgagttgctgcttttctcttggttgacaggaaataacgacatgcacttgaaaaacttctctttgtatgaggtagcggataagatacgtttaacccctgcttacgatttgctaaatgcggctatcatcaatcccaaggatgacgaagaactggcattgaccttgaatggtcggaagaaaaagcttcaaagagaggattttatcaggtcagcagctacgttgggtatagagaatgtgattgtagaacgattgataaataagtatatcaaactattgcccaagtttgagactgtcattaaaagctctttcctaagtgctgaattaaaagaaaagtatggcgaattgttgaaggaccggcttgcaaggctttcgcaagggctataacggtaaaataacaatgctatggatatcccttgtagcctttatgatgtattgaggcttttcagttattcgaaattttcgaataactgaaaagtgataatactatgataggtgagtattcaatcttgttttgattgcttgcgtttttgtgcataatgttcatttatcattttgtgaacttcatccatagaaataagtccttctatatgtttacgtgctgtttcgataaggaagttcgatacacacaggttatcaactgcttgtaacccaatagaagctcgccaaagcttggctcgttcacgtttctctaagttttcatcattcagatattcttcaaatatatgcatacctcttattgcttgcttgtttagttagaagatataggctgcaaaaatagcaaaataatctcaatacttgaatatatatcattgataatctgaggattgtggtgttgaaaatattaggagtatcattttcgaaaaagatcgtgatggtttagtgatattacaataactatatttgtttgaatatgaacagcttttttgagaatgcttggttatgtggaaaattaaatgtaattttgttcacaatttaacgagtataaattgaatatagatgtcgaataatcaacaaatagtgatgaatcggattaaagtggtacttgctgaaaagcaacgaaccaatagatggttagcggaacaaactgggaaatcggagaacacaatctcaagatggtgctctaataaatcacaaccatctatagcacagttacaagaaattgcaaatttattggatgttgatgtgagggtcttgataaggccaactaaatagaactgaaattatatatagggaattttatgaataaagtctataatggagattctcgttgtttgttagaaatactccctgaaggtgtacaagttcaaacgacaataacttcgcctccgtattttgatatgaaggattatggtgttgaaggacaggtcggtttcgggcaaaaatatgaagagtacttagaagatctaaaggaaatatttgcacagatatatactgttacaaaagatgatggaacattatggattgtgatagatacttttaagcgagatcacgctgtagttacattgccttttgatttggtccaaaaattaaatagtgtaggatggaaacttcaagaaattattatttggaaaaaggataaaactgttccatggtcatctaaaggttttatgcaaagaaaatttgaatatgtattattcttttctaagcaaaataattataaaaccaataaggatcaagttcgaatttatgacactcaacaactgaaaaaatggtgggtgaaataccctgaacgatataatcctaaaggaaaagcattagatgagatatgggagttccctataccagtacaaggatcgtggggaactgaatatataagacatttttgtccactgcccaaagaaatggttgctacaatgatatctataagcactgacgaggaagatgtagtgtttgatccatttgcaggaagcggtgctgtaatgtctcaatctgcatatatgaaacgaacatatttaggaatagaaatcaaccctcaatatatcaatatgtttgaagcttatcttaagtctacgattgaaagtggtaagaaagagtattactcatatatgaacacaatggatcaggttgcatttgaaactacaattcagaatcttcgtgctcttaaatacggacgaatactattgaataatatagaaaaagattatggaataaatgatctgaaaatatatgtgcaaagaacagaatcatcaatatcttcaaaaatcaaagttgaatatacttttattggaagacagttggatgacgaattttaccgaatgatttctacatatacaaatcgtccaccactatcgaaatatggaattatacctacttttaaatgtggtattgatttgagtatgttaaatatagaaatatatatgtattcaaagacaaactcacattcttatttgagggattgcaattacatggattcaaaagtgaaaataattagcccaataaaagttgatctttatgaaaaagactttgaataagaaatctgctagaagaaaaagaaaagtcatgtctcctgaagagagattgagaaagaaagaacaacgagatcagatgaaagaaatacgggatataatgttccgcatcggttttactcgtttatcaggaattgatgggaaagaatttgtatatgatgggagaactagtgaattagatgatatatttatttgtgaaaatgtaattttacttacagaatatacgattggcgatccgcatatactaaaaaagaagattatttatgataagataaatagtgatatccatgcattcgttaaatatctaatagacaacaagatatttgatagttttaatgatatatataagaacagtatctctaataaatatactgttaaccagatgcgggttaaagtattatactgttctaaaaaaagtatttcgcaggaacataaagataatgtattaaatgtcatttatttcgattatcatattgtgaaatatttcaaaagtctaacaggtgtcgttaaattatcagctcgatatgaatttatggattttcttggcatcaaagaaaatgaatggggagataatattcttaattcaagtgttggtacaacaagttgcttttcgggacatattttaccagaagaaagaagttctttcaaagaaggatataaaattatctcattctatattgatgcggaatctttattaaaacgagcttatgtcttaaggcaagaggggtggcgaaagaaagagaatgtcggttactatcaacgcatgttggatgctaagaaaatcgttagtatgagacgatatctttcttctgagagaagagtgtttataaataacattattacaactatttcagagaatgatattagaatgtataaagaccaaaatagaagagaagaaatcgttatagatgaaaatggtaattttgttggtgataacaaacgcactaatgttactcctgcttatgttgaaattctaaataaatgtaacataataggaataatagatggacaacatagaacttttgcatatcacgaagggaatgatgtatatgaagaatctataaagaggttaaggaagatacagaatctattagtaacaggcataattttccccaaaacggaaagcaaagaaaatagattaaagtttgaagctggtttatttcttgaaataaactctaatcagaaaaaagtaggacaattaattcaacaggagatacagatgcaaataaaaccattttcaaatattgcagttagtaagcgtatccttaatatgcttaatgaacatggagctttggcaaatatgatagaattatatacatatgaaaaaggaaaaattaaaacggcttctgtcgttagttttggattaaaacctttgattaagtttgacttggacaaaaatgattcattttatagtatttggaatcatgaaaataaaaaggagttactagaagctaactgtcaaaattatgctctcctagatgaatacataaaattttgtgttaaagagattaatgaggtaatgtccgcttttaaatcatgtttgaaaagttatgaatggaaaccttattgtgctaaagcttcatcgggagttcttacagttacttttataaatggtgtcctaaatctaataagattgttaatagaaaataatcagctaaatggaatagatagttatcgtgataagttgaagtcaatagatgggtttaatattaaacagtataaatcaagtcaatatcgacgtatgggagaggatatatataacaaatattttacaactaagtgatttatgattattcctcaatccaatacgctaactacacgacatctcaaccgggtatttgacaagactgtagctacttataaatattattggttcctcggtattcttgatttgtatgtgaaacaaggaaagacgagaatgaatgtgtgggatataatgattttgatggtaactaatgcttggtatcctgttaattatttccgtctttcattcggtaagtcagaatcgctttatgaaacaattttgactttacaagaggagaataatattcctatcaatataggagtaagagaattaatggacttacttcaaacattaattcaacgaaaagatgtccgaaagaaacttaattttcttcaattgaatgtcccttttcgttttcttcgtccatggatagatacttcagatgaccgggacatggtgaaacgttcacaagctttcgagaatggttgtttatatagacttaaaaaagagaatggcacattgtgggtagatttgaatccaatatggctaacctatttacaagagaattacgatatactaagttcgttcgcttattggggattgacaaacttcttgcaagttcgtaatccaaatgtcccaaatattccaagcaaacttataaagaaagaggaaagaaactcattgtctgctcaaagaaagttttgggatacagctatatgtagtggattagaagtaagatgtccctatacggacagattgttggatgaacgtgaatacgaccttgaccactttatcccttggagttttgtttctcatgatttgctttggaatctcatgcctactgattcaagtattaatagttcaaagagcaataaactaccggatttgaatttatatcttcctaaattggctgaagctcatcaagcggctttaaaaattaatcttggaaagggaaaacaagaaaaattgttggaagattatttatctcttggctatactccgcaagatatagcaatgatggatagagaacatttattagattgcttttttcaaacatttactcctatgaatcaaatcgcactcaatatgggatttgaatcatggaaatactaataactatgcagcctgaaataataaaccatccatacctcacagccattaagcggacagatttatctgttcctactcgttatctcttacagcacaacttgttgaaaggacgtattcttgattatggatgtggcttcggatatgataccgatgaactaattaaaaggggctataatattattggctacgattattattatcgtccctactatcctgaaggtaagttcgatacaattatctgcaactatgtcttgaatgttctagaaccttatgctcaagcagaggtgttgatgaatgttaccaatctgctatcttctaatggaacagctttttttgcagttcgacgcgacttggtagaagaaggtttccgacttcatgccatttacaaacagtacacttatcaatgtaatgtaaaactcccattcctaagtttgaccagtaacagtagctatgaactttatcaatataatcatttcaataaactattgcgaaaagaaggagaaacttgccctttctgtaggttgtctcgcaaagtggagataatctgtgaaacggccacttgtcttgctttctatgatggttatccagtttcgccaggtcatgctcttatcattcctaaacgtcatgtagctaattattttgacttaaccaaccacgaacgtgaagccatgaatgtgatgcttcaatttgtgaaacgaaaaattgatgatcgttttaaccctgacggttataacattggaattaatgtgaataaagcagcaggacaatccgttttccatgtacatatgcacattatccctcggtatcaaggagatgtgcaaaaccctaaaggtggcgtacgtggtgtgattcctaataaacaaaaatattgatttaatatgtctcaagaaattcaatttatattatataatctcccagatgaaggcgggaaagtgcaagtaatcatcagggatgaaactctttggtgcacgcagaaagctatgtctcagctttttggtgtagatagaactgttatctcaaagcatcttaaaaatatatttgaatcatctgagttacaacaagattcagtatgtgcaaaatttgcacatactgctgaagatggcaaaatatacaatacgcaattttacaatctggatgctgttatctcagtaggttatcgtgtaaattccttacaagccactcgctttcgccaatgggctactaaaattctgaatgaatacattaaaaagggatttgttcttgacgatgatcgtttgaagcaaggggaaactgtatttggacaggattactttcaagaattgcttgaaagaattcgttccatccgtgcaagtgaacgtaggatttggcagaaaattacggatatatacgctgagtgtagcgtagactatgacaagaactccccaacaacacatgatttctatgcgatgattcaaaattgtttccattatgcaattataggacaaacagctgctgaaattgtatatcataatgcggatcataccaaagaacacatggggttgactacttggaagaactctcccaatggtcgcatattgaagtctgatgttattgttgccaaaaactatctgcaagagaaagagataaaggatttagaactagctgtatcggcattctttgactatattgaaaacattattaggcgtcgaaatacattcaatatggagcaattcgctggtagtgtaactaagttcttgtcgtttatggattatcagattttgccagataaagggcgtatttcagcggctcaagcaaaagcaaaggcagaacaggagtatgatatttttaatcggactcaattaattgattctgattttgataagcaaattagaggtctaatggaataaggagaggaaaaatcccctcctttttctaaaaccatgtctcagacattcaaatccttcagtgcaagtgcataattgggacaaaaaccgtccattatacacttcaagccaagtgtctgataatacttgtagtcatcgtcttcggtacataggtatttgtaaccgtagcgtggcatgtactccttgaagaaacgagccaagtctttcaggctttcttcttggttctttttgaagttactacgcacaatgatgatagaccagtcggggaagttgcctcttccacagctatactcccagaagcggatatagcagtctaagtcacgttcacggatgtccacacaaaagccgttggcattttgcatcacgctacagctttctctgtagccaaacttctcacacaagtagagattgaaatcaagaattaaatctttttgaatcataaataattgaatttaagatgttaataaaaagtggattataaatgaaagcctcgcttgcgcttagccttttttcttttcatcaggcgattgaactctgcttcttctgcggcagtggcatcgtaggatgaacttccgtttagcaagccgagactgaagtcaaagctgttatcggaatgggaaacgttttgttgcacctcttctttctgctgttcgggttcctgtttggcaaactctaacaaggatgcacaagcattctcttccaatcggttgttgatattcaggtagctgaactctcgacttatttttgaaccggagaaagaaaagccgttatgctcaaacttgacaccttgtatttctcgtgtagtcctactgactttgaatttcatatcaatgtctcggtcggcaagcacatctttcaaatcatcccaactatgagttttgggcaattcttctttcaatgccttgtatatctcatgttttgccttatcataggggcgcaaacgttcctctttgatatggtctttaccattggcaaagtgcaagcgatatttggcggtcagcattttgcaaactttctcatttctgcggaagtcattcttgtcgctaatcgtcttgccgtcattattcactcggttgaaaacgatatggcaatgaggatgctcacggtcgatatgtcgagcaatgatgtattgcgtattctcaatacccatcagtttcatatagtcgtgcgctatgctcagcatcagggtgtcatcggactttagccttgcactatcttccggtgagaagttgagcgaagtgtgtccgacaatattctttaccttatcgttgagtaatgcttgtaactcaaattgctctgccatctgttcgggtgtaccttctactcctaccgcctccaatagcttggatttttcctctttgaggacatagcggacgcaaccaccgaatgacgttcctttagtttgtttacctatcatctttcagtcgttttataagttgattaatgtgttgagccatttcttcgcatctgtccgcaacagcaaagaaaccgtaggtgtttgcctgtcttgccaactggttaagattggtgctttcgccaatcagttgacggatgatgtggatatgctcttgcgtgattcgttcacgtaccgaaccattctcgatgagtgaacggatgacttcgctctgagtttgcttgctccgtctgcaaagcgcaccaagccatgcgtgttgttgatatgacagacggagtgttattgtatatttcttttccatgtgaattgtttttagtgaataatttgtgaccatcgggagccgcctcctcagactttttgaggagcaagtggtcgggaaatgtaatacaccgacattaacttgctacagtaaaaagtctcaatttctctccttgagttcaaagtctgaatcctcgtttcttgggtggtgaaaccttcggttgcggagtgtcttgttgtatgctaatgagtttcaaatcgaatgtttttattagtgttttcaaggcaggattcatccttatcatctgttggaggatagcttcaacaggtttcattttgagcagataatcggctatgtcgtatccctctttccgctcgttttcggtggcgttggcttccagataatcgaacatctgcacctcaattccgtaacttttcatcagaccgattttgctctgccaatagtcggtcgctcccaaatcaggaaataatacgacgcttcttcctgccagagcggataggctattggcattgaagcaaccgttctttccccctgatgctatccataggaattgcggcagatagtaggaagcgataattgccgttttctcgctttcgaccagtgcgacaggacggcttttttcttcaggaagcagatgctcaccaaagaagcattgcttcaaattgtaatcgcctttgtgcagtacggagtgtacccacgtgacatgattgtacggttcttttatccgcttacctgtttcgggattgtaaagcattatcttacccgtgcggactttattctgattgtccgtttgccagaatacagttgcaccgtcccaatacttggatgtaccgaccttgtatctcttcatgagctttaatgtttctgtttctccgaactgagccgatagaaattgaaacaacttgttcgtaggatagccacgcaatgattggttgactatatccaaatcaatgtaggatgtgaccagaggttgtgcttccttaatcggtacataactcctgaaactatcttctgcaaacttttctttttcagacgggttctgctcaaagtaatcacgaggcgtgaagtgataaccgcatttctgctcatggtcacaacgtcccacgtactctgggaacttgatttgcttctccgtatcaatgtactttgaaaaacatctttggcggtggcagttcgggcaagaatgccgagtgctgatacctttgtagggttctaatatgaatctatgtgtactcattgtatgtgtcttttttggtgtgtcacttttgtcgttattgtcgttttctcttggaaagtgtcaaaaccgacaaaaatgtcacagattaatctttgaatattctccatgtttctctttgcggaacagtatcccgatattgtcattgagaaagcgttgaaacgtccgttccttcattccgttctgctcggctatttgtatagcttgggctgttgtaaaggatagaggaagcagattgactatcgcctgttgttggatgttgagcgcattttcattgagtatgttttgaacgctcaatgcggattctttgaagtactccgtcagtttgatggctcgttctaccgtcaacaagtcgatataggttttatcacactctccacaagtccatcgggctaattggataatcaggcagaaacggataatgtatatctccagcttacaatagatactcacgattgtgtcgtttgtctcccggtcgcacaactctgagaagtgatgctgccattcgtaaagccgtctcttggcatcttccgtgaaaagaagaatatgcggttctatctctccaaactcattgagggcatactcttgttgtatcagcttatcaataatggcattccattcttgttcgatattctctggcagttccttgtcgttccaacgtgctttctgttgcaggttgggcatcacaaacagaatacggtcaatgaatccattactggaacgttcgcctttagccagttcactgagaattttcttttggatagtaccgataaccgaaatatacggtcgcttgatgaagatggaactcttggcattcttgcggtcggatatagtcgtcttggcactgaacactgacaaccagaattgttcttctgaaccgttgttgtagcggttgaagttcttgaaccaagcggacaattcatcagcccacaagcataaacctcgtttgttctgcgcatgaataaggctcaatccttcgggcgttacatccgaaatcaagaagcgtttacgaattggttcctgtgggaattgctcttcaccactatccgcacgttctttgcggctcatgctcataagctcattgtacttggcaagcattttctcaaattcttgattctgtttgtaatcataatcaagaaacggtttcatggcaaagctgagcggatggctcttgtttgctcccggtcgtccaatcaatgctatatacaggatagggctttccacccagccttgcttgatttgggcaagatgcgtgttgccaatgccgactgctattgccgtaaggatagctgtggcaatgtagtcggttgggtagttatggcattcgtgaacctcgctgatgatgcgttggatttttgtcgggaatatgctaacaggaaaatcagtacccgttagtcgcatactcaaatcaaccgcttcatcaatgatggatgccggattaatagaatacgtatccatattcacaccgattaaagtttcacggatgatttgggcttatgacggacaccgccttgcatattggcaagcatctcttcgtatgtttgctcggaagtttttcttcgaccattctcaatccatgccagaagttcgtcttcgtagaaatagagttttttgccttttttataggcaggaagcagccctttgcgtaccaatgtataaatggtaggcttggcttttctgataatacggcaagcatcctcaatttcaaccaacacatgtttgtctgatgccggtggctggagttcagctaccatctttttcaactcgataacctgttcgctatagtgcaaagaatattatgagaaaattaggcagaattatccgagatatatcggaacttatgaataacctatgtcgggttgacacgtatctgaatgatgataatgaggaaaactacaaaaatatagttcgtcttattgctaatggaacaaatttcgttgtatataagtctgaaggacaatatcattttgcgccaagtcgatttgtcgggtatctaaataatgatttgttgacacatctggtaaaaaagaatgggaagaacggcagagaaacatctccagctattgatagtattattgggcatacaagggcttttaatcaggcattagaagatgaatatttaggattttgtgataggttgggtattactcctaaacatatggttaatactcaaagaaaatactggttattagacaataaacagaacaaaatatacacagaagaatattatgagggttctttgcagcaagcattagtcaatagatacgaacgcaatcctattgctcgtaaaaaatgtattgaaaaacacggatgtatatgtcaagtttgtggaatggattttggcaaagtgtatggagacttaggtaaaggatttattcatgtacaccacatcgttcccatttcaacccggaaaggggaaccgcataaattgaccctgagaatagctttgttccagtatgtcctaattgccatgcaatgttgcataaaggtaagctttgtatagaggaactaagaaagatattaggcaagtgatattaagcaatcttcttgtctaatttaatcctacactcagattccgtgtgtgacattttgcgctcaatggtggatatttccgaatcacggagagtgtgagcgaatactctctttataaatgtagctgttagtaagcgtggcttaccgaatgccttgcctatattccaaccaaagtgcatgatgtcaatggtttttaattgagcatcaacctttatctgctcaactttaggcagagtatctgataagtaatattccgtaatatatccacatagacgattgagatcagtttcgctaaggtagagagccaagttctgtacagatcaagacgtggaatatacaaatcacgacgtggtctatatattccacggtgataatttggaaatagatcaagtagttagtatatttgtatatagtaagaagaatgtttttaacttgaagatacgaacaattatacctagtagcagttatggcagaatatatcaagcaagagatgtgcgacctgaacgggacgggggaaaagccggtgtattatcggatgaagatacaacggaacatggacatggaggatttcgtggaacggatcacctaccccggatcgggcttgagcaggggtagcgtaatacaggtgatgacgacagtagcggaacatctggcctattgcatggcggaagggcagtcggtcacgttggatggcatcggtacgttcacgccccgcctaggcgtagcgaaggacaaggagatcgactcgctggatggtgacgaaccgaagcgtaacgcacggagcatcgaggtgaatggtatcaactaccgggccgacaaggaactgatacgggagactaacctgcgttgcgatttaagacggggaggtatcagccgtgtccggaaatcgcccttcaccgaagaggaacgccggacacgggcattggattatctggatgaacacccattcttgcgcatacaagactacatggctgtcaccggactaaaacgtagtagcgcaaaccgtgagctactacgcctcagtagcgacccggcgagtggaatcaccctatcgggttatggaagccaccgggtgtatgtccgcaggaaaacagagggcgatcactaatccacccaatgatgccccgggccggagaaaatacatacattttactccggcttttgactaagcatttgtattgtttcagtaaactccgcgactatagacttcaaattgggattatcgagccgaataataatcgccgcataattctgtatcccatccgcatctcggatgtccgcagacatgaaagcgaaatcagatttacgcggcgaggaatgaaaccaaaactcaaaaaggcgattgcgcatactctgcttgctatctcctgtctcacaaatatacaacagagttgtattagaacattcaaaaaactcatagactatcgccattatcgcccgcctcaacttagaatcacgaggagactttctattattcgtattagcaataataaattgataggattcatcactaagcatcaattcgtcctcgagaaaactgacataataaatcacaccaaagtccgtaacaaaccggaaacacatagaatccctaagagctgttaccgcataaggagaattagaatttatacgtttaaggttaaggcttaccatacttcaaaataagtagcttcttgccctgtacgtttcttaaactcttctttcatctctttttccagtttagctacatactctcgcttcagcttccgtgcggtctccaaccgacgcaaagcctcttctctggtaatcttgctatttttctctttttccatacccttcgatataatacttatatattacaaatgtaggataaattccgttctttaccaaaatatttattctttgcttctgtttttgagaaatataacaaacacacagatcactaatccacttgatggtgtcccgggtcgagatgcttgcgactgccgttcggtcttatcagttcggcggaggtgccttccgggatttggagatcgaacttcaatcgcttgcctttcttcttgatacttacttgtatggttccataatgggtctctaagctggcagaggcttccgataagggacccaattgaggcgagatcttaaaggtacggaagccgggagaggttggctcgataccgcagaccttctggctcaataaggtaagcgggccaccgctccaagcgtgattgatcgtgccgccaccgaagccctcggctccgatgccccatccctcgaacaaggtcgtgtattcggcataatccagcatacgggtgtaacgttgcttcatccgttccaaggcaaacgccggctcgcccatctggaaaagggcctctaggacatacttctccatataagggctggcgtgatactcctttttaagtaccttcgtcagcgccggatacttatctttcgaggccagcccggaaacaaccgccatggcttgggagcgatcgtccgtctcccctttatagccgggggagcgataggcggaacctgtccagaacttcgtgtcgaaacaacgttctatgctacgcatcatccgggagatctcatcggcatccttatccttgccgagttgcagggcgaaggctcgctccgctttcaaggccagataataccagcagttggtcaatacacccatatcgacatgctcgccccagtcgccccagctccaagcgccttgacgctcgatcaccaagccactcttatcgacttgccaaacctcgtgcaggtaacggcgcatccggtcgtatatcaccgggacgaaactactgtcggcactataataatattgcgtataaaaaccgtaccaaccgatagacgccaacatctgtaaaggaagctccttatcccaattacccgccggaaccggagcgtagagcgttccgtcctcccgctgccaattcattaattcatggatgccttttacggctagtttctgcccggacggagaaagggcgtagaaagcctcgcctagctcattcacctcgtcaccccaccattgggcacgttcacggtccggacagtccatataattatcacgcatcgttatgtataaagtgcgggcagaacgttgccaaagctcgtcgtagaacgggtcatcacaatggaaagagccagcgaggtccgtgttgtaaccggtctcacggtatttcacatccagcaccttcacgcccttgggaatgatataatagacctcatggccgttcatccagccatagctttcgtattcctgctcaccctcacgggtaatatattcggcacgtacgttgcgctcgcttcctccctcgtaattatccatccggatgtggatagtcttcccggcctccgcctctacttttagatacggagtgatctgggcattatagggcaaacgacagaacagggtatcgcctctcaaggattcccggacggatacataggataacaggccgctgtttttccactggggtatcggacgttccaccagatccccgaaaggagctttccccgccttaccgacgcagaccgcccccggaagggaaccttcaaaactcgtacggttccagtttgttatcgcttgacgggcatcgaagcgaatattactctccggcatacggtaattcgggaaaggggcctcggtattttgataggcctcatacaaggcacactgccagctcgcgtcggagacgatctccagccccggagcgatcgcctcaaataacaaagctgctttcccgctgttgatatgactgaaaccgtctttcccgaaatgccagagcaagatagcgatggtgttcgagccttttgtcaggtaaggggcgatatctaccggatcgtaataagtcccggaaggagaaggtcctcttttcaagccaccctcgaagataaccagttggtcgttgatccaaagccaatacttggaatcggcggcgatacgggcgatgagttgattcgggacatccgtcacagcgaatgatttacggtagatcaaccaagtattcgtagcgctttggcaacgctcggtattgatccattgggctttccaagggaaggcagcgggacaactgtccgaggcagtcacttttatccagctgaaagataggagaaacaatagaagagcaagaagtagcttgttcatacgtttaatctttaaggttctcaattatttgctttcgaaatccccagttgtagagacggggcacgccccgtctctacaactaggtaaaataagccaatataggcgatgtcattaccggcttactaaagtcatacggttcttatcacaccggatatgaaaacgtatgcgtaccggcggatacggtctcggtctgatcgcctaccacgatatcggcggagcaatcagccggaatcgtcacggtaagcataaccttatccccttcccgtttccattcgctggcgatacggccgcgtacggaatgatactcacctttcgcccaatccagttctttcacgaaatgaggcgtgatacggatatgacggaagcccggagccgagtcatcatgattgataccggccagctggttcatcatccaagcggagacatctcccataaagacatggttcaaggaagcgtcggcaaacttcggactaagtgtccacgtctccggcaatgtggagtaacccatcgtctctacccaatatccccaagaaggtgcctcggtcttcgtgatcatcttcatggcatcctcgatatagccatatttcgtaagcatggccggaacggtcttactgcctaatagaccaaaatccaagaaatagttatttcccgctaccgcctcacgcagcttatccgccacgagttgttcctttccttccggtacaagtcccagatacaaggccaaggcttgcgccgtttgggtcccttcggcatacacaccggtctcggcattgaagaacttccggttgatcaaggatttgagggtattcgctttctcttgataaggagcggcatccttgcccagcaaagaggcgaagcgagccatcaacttataatccagataatagtaggcggtagaggtatattcattattcgtcgtagctttccaatacacccagtcacccaagccaaacggcaagtaaccgtctttctctttcgtcttcaaataatccagatatcgcagcatcgtaggatataagcgttctatactgcgagactctccataataatcatacaaggcgttcgggatgataaacatgacagcgtcccaaaccggacccggccactcgccatatccccaaccgctggaaggaatgataccggaaatctcacccgcctcacgctggttatcgataatatcattcatccatttctcataaagcgtgataccatcgaagcccagcaaaccgaggtcgatcgcgatatgcgcatcggctgtccagccattcttctcccgttgcgggcaatcggtcgggatactgtgcaggttactgcggtaagcctgcatcgtagcctcccatatcttattcaatagaggattcgaacaagcgaaggaaccggacggacggacatcggtatgcataaacaagccggtcaagttctcttccgttaaagtaacgggacggctactctccacctccacgtattggaaaccgtgataagagaaggaaggcatgaagatctcctcctctcccgtacctttcaaggtaaagacatccatctggaatacctcgtccggtttgaccggatgataatatacattgatattgccttgctccaagcgaccgtctgtcttcaacaactcaccatgttttaacgtgatacgggttcccgcctcacctttcaccttcaagcggcaaaggccggacatgttcttcgggaaagaatatacatataactgatcggagaaacgtttcatcgacacgggcctcacctcttccgtgatacggattcccggcatttgctgggctaccaacagaggtgccggagcctgcgccggaagtgccgcttcccatttactatcgtcgaaatgagcggttttccatccggcctcttccagccgggcatcgaatttatcgccgctgtatatattattataggtataggcacctgtggaagtcttccaagtctcatccgagccaatcacctccgtcgtaccatccgtataggtaatacgcaactcacatagcaggcggggacgattccgccagcgtgcctcatgaaaattccagaccgccacggactgctcattgtaccagccgtttcccagaacagcggccacggcgttgtcgccttgcttcagcaaagaggtaacatcatgcgtcacgtacaagatacgtttatcgaaatgcgtataccccgggtccagataattcgttccgacccgctcgccattgatgaatagctcatgatacccagcagatgctacgtacacacgggcatccttcacttccttgcctaccgggaaagacttgcggaacagaggggcaggctcgaactccttatccttatgatcggtaatccaagaggcggaccaatccgagggatcgaacttagcggtctcgaaagaagccgtctccgaggtagcgcacggacgcccttcaccatcccataccgtaacattccagtaataacgggtatgaggtttcagggccattccctccgcatagggccgcaagtcgtccggactcgtaccgatccgtacctcatagcgggaagccttaaagccctcctcatttccggagtattcccatgtaaagcgaggagacgaagtatccaagccgataggctccgtaaggtattccgtacggagattcgtaggtatcgttaattcattattgcttttacaaccgcctaataagagggcggcgaaagcgtagatgcaaatagtttgtttcatatattctataattatatacattctacaactaagtataagagctacggggtaactcgtatctcttcaggagcgttgatatggcttatcaccttaccgtccgcacctttctcatgtcggatctcgatcaccccgtaaggcgtgggaaacgtaccttccacccattcgagatctcccagatgtgggatgatacgtaccgtacggcaacccggttccaccacttgtacgcccaatacgtactcgcttaaccacgatgtgggacccgaagcccatccatggcacaagctatggcggaaaccttgatagcaatacgccccataatctccatgaatatctttctttccagcggggaccagctcatcaatacgccctgcgtccggaagccattccatattgaaatcctcccaaaacgtcgtagcacctacatccagcatagcaccccaatacgtacggatcacatctaacgcaccttggtaattaccagccaacgccatcgcccgtagcatataatacccgtaaaacgtagagaagcctttcgccccgtccaccgccaagcaacgctcgttcgcctccttagcatccatgatacccgccagagccatcaaggcggcggcctgtttatccccgggcgtaatccgatctttctccgaagggaaccgggatttcttccgaagggaaaacttaatagccttggaagctaccatacgacattccgaagccaacgcatcctcgcctaaaacggtacataactcctctcccgcacgcatggcttgtatcatcagcgattgaaggccggcatcgatagcgggtgtattctcactggaaggccaatccaagaaacggttcccatccagtctctcttgtccgcttgggtcaaccttcgagatcaagtgacgcaacaaagcagtcatataagagcgttgctcttgtagatacgcaagattcccttgataataataccaatcccgctgaatcaacaaccaccagatcgagtacgaactgataccgttcatccaactaggcagcggcgtaatatcccgaatcaaatccaagctcttaggaaccacctcattataaccgaagacggtactgaccgtcattacctccggatgtaaatcccccacccagaccagacgatcccgctttacgccgtcccatagatattcctgcatattcaagtggaccgtgtacgcaccagtcttccagatccggttcaaccgctcgtcattacaacggaaagagcccagataaggaatatcccggaacgtggagatcgcacggacctcttttaattgcaactccgtagaatcacccaatacatcaatacgcacgaaacggaaaccggaattaccgatctcctgcacgcccagccaagggagcgataccacgaaatcccgcatcgcatgatcgttgctcgccccgttcgcgccatctatctcgcacatagcctcactaacggactcgccgaaacgaacccgtacggaaaccggatcgtgagacggcggcataccggtcaccagctgaaggccgccttgcaactccttcccgaaatcaagcagcaaagcgggatgttcggttggcgtacttttcaacacacacaaccgattattcgccaaatccgactgtccgttgcccggaacaagcaaatggtccgctcccgtaattcgcgaactatcttgctgccagacaatacggaccggagcgatatactcccgtgtccgatggtctcgctgctgggcgaacaacgtgaacgaaccgatccctatgaatagaatgattaatttctttcgcatacgctagagtccaaaagccggaaccaagtcatccaattgctgatccgtcataccttccggctcgtaaccggtcatgcgggcactgaaatagatctgggcggatttactcaacgtatcgatcgcatcgaagcactcgatcaggtcctcaccgacggcaaggataccgtgcttctcccagaacaccacgtcgtgctcctccaactgacggatcgtagcgtgcgccaacgccaaagtgcccggtatctcgtaaggaacgataccgacccctttcggcacgataatccgacattccgggatcatactccataacgtgcgggtaatcttctccgaatccaagaacggcttgcaatgcgtcatgccgataatatccgtcggatgcgtatgcaataccacccggttatcccgtcccttcgcacgcaagaaattgtgcatcaacaaatgggaaggcaactcggaagtcggttggatcggttgctccgctaggatatcatacgatttcccatcggcggcgatacggatcaaagagccgttggcgaaaggatctttcgccacgtaacgcatccgttttccggtacccgtcacataaaagacgtgcccgcataaggccgtcatcgcctcttgcaagggaatcgaggaaaccaaagccggcaacgccttctcctcctcgctcaataaagtagtcaggttcaccgatatattcccgccgtttcgctcagcccaacccttggtccacaaatagccggcgacctcggcgatacgatctatttccgccatcaggcgttcattgtttcttagtgttatcatgtctattttaattaaactatattcggatataataaggaaaggatcaagatacacatgccggtaatcaataccacgatcgtccggcgatccacgcccttccattcttttaataagatgccccagacattactgaaaataacattcaacgacatcaggatactccacgagaaagccagcataaccggggaatccgagaaatagctctttcccatccccagtccgaagaactgcgagtaccaaagcacgcctgccaaagcgcaaaataaggcattattcagcaatgtacctcccgataccgagaaataatccttgcccgtcccgtttttcacgttctggaaaatacaatacacagcgttcgtacaaaagccgcccaaagtaaccaacagtattacgggattcaaggcgaacagatcgctagctcccgcctctttcgctttcgccagcacctcgtttcccgattccaaacccaaattgaagcaggcgctcatcacaccggcaagcaaggctaccgccaagcccttagtcaaggcaaaatccttcaccgccgctttcttctcctcctcactcatattccgggcccgcaggcttccggcgtaaccgatcacggcgatacctgccaaggtaatgcaaacaccggtcaacaggatcaatccggttccctcaaacagattcgttccaccgaacaaagccgggaagagcgtaccgaaaccggcgcatgtacccaaggcgatgctctgtcccaatgctacgcccagataacgcatactcaacccgaaagtcaacccgccgacaccccagagcatgccatagataaccgctcccaagctacccggcgaacaccatagctccagtaaggtactcccttccggtaccgccaacatcgctccgagataagggaaaaccaaccaagcgaagataccttgcaccagccaaaagctttcccaactccaatcccggatcttattgatcggcacgtacgagctactctgcccgaaactgccgatcgcaatgatcaacaacccgatcccgatctctatcattgccgtcttgaggtaacgtcggactcatatttctcgatctcagcgatataagactctcctacggggaccccactttgtagacaatacatatcccaaaccgccccccaaggcagactcttcgcttcctcctgcaaggcaagacgctggaaatacttaccctcatcctcgtactggcgaagcaaggcgatcggctccagcaaagcgagcataaaggctttttgcgtagcacggctaccaatgacataagcaccgatacgattgatggtagcgtcgaaataatccaaaccgatatgtacccggtccaaggcgtcgcaacgcacgatctcacgggctaaatcctgcacatcgtcattcaagatcacgacatgatcgctatcccaacggatcggacgacttacgtgcaacatgatctcgggcgtaaacagcaataacgaggaaaccttgtcggcgatactttccgtcaaatggaaatggccggtgtccaaggtaacgatcttgttctttttcgccccgtaacccaaatagaaatcataggaacctaccgtataactttccagaccgataccgaagagtttcgcctcgatacaatctttcatccatttatattcggtagcgaatatctcatccagcgattcctccaagatacggcgataacgtaagcggctggccggtacttccttgctcccgtcatgtatccaaaggttcatcatgcaaggatcgttctgggctttacccatctcatcgctgatccagcgacaacgcttcgtatgctcgatccagaagttacggatatcatcgctggggttcgccaaggtcaaatctccgcttttagggtgcgagaaagaggtactgttgaagtctagcttgaaatcattctctttcgcccattgtatccagctctcgaaatgatggggttctacctcgtcacggtctactttctccccttggaaatccccgtagatctcatgcagactaagccgatgattaccggggatataggatttcgctttcaatacatcccgacgcaactcgtcgatagtacgggcacgtcccggataattgccggtcacttgtataccaccggtcaaggagccgccttggttctcgaaaccgcttacgtcatcggcctgccagcaatgcagggatagggatattttcttcatatcctctaaagctttacgaacgtctacacctacggccgcataacgttctgccgctacttcaaatgcctgttgaattaaactgtcttttgtcatggtatgatgtttttaaatttatatgatttgaaagtgtatcacctttccggataaaattccttgggagggaatgcggtggctatcagtcttcgcatctcccaacaatccgtcagtaatcctgccgacttagcctgtatcaagcaatttccaatggcagtcgcctcagacgggcctgccaatacgggaataccgatagcgttggctgtcaactgattcagcagatcgttccgagagccaccacctatcacatgcaatcgttcgatcggatgtggcgacatcggtttgagtatttccagcacctctttataacgattcgccaagctataaaatatacaatgtacataatcggcgtccgaagcgggaacagcctgtccggtttcctcacaataggccgtgatctcacgtagcatactctcaggattggcgaaacgaggatcatccggattgatcaaagaagtaaattcgttcaactccgccatccgaaccatatcatcgtacgaataatccaatccggaccgcttccattgctcccggcaacgttccaagatccacatacctgtaatattcttcaaaaagcgagtcgtaccctcgatacccccctcattcgtgaaattattcttgaaagatacctcgttgatgatcggcttctccacctcgatacccatcaagctccaagtaccactactcaagtaagcgaaattaggagaagaagcaggaacagcggctaccgccgacgccgtatcgtgaccagccacggcgattaccgggatttccccgattcctgtcttacgggcgatcgactcgctcaaccgcccgatcaacgtccccggcatcaccaccggacacatcaaagtaggagatacacccacggcctccaagagcttgtaatcgaatttatgggtttccggattcaataattgagacgtggaagcgatcgtatattcacataccatacgctccgtcaacatataagccaaaaggtccggtatgaataatatcttttccgccacttcctgcggtataaacgagtcttgccccgccctgaaaagctggaacaagctattaaacggcatcacttgaatacctgtccgcttatagacctcttccttgggaatccgtttgaaaaagtcctcgggagcgccgtccgtataaggatctcggtaagcacgaggtaagcccaataaagagccatccaaagccacatacccaaaatccaccccccatgtatctattccgatcgagtgcaaccggattctttgccggacgcatatcgtcaagctttctataagagaagtataaagatgatagatatcccaataaaaccgtccgtgtaattccaccatcggattcgggaaccgatggatctctttcatttcaaatttggcatcctttaaggtcccgagcacggcccgtccactggtagcccctatatcaaaggctagaaaattatattccttcatggcttaacaaagttatttgtttgacgaaagcaaaagtagaagcattattgctatatttgcttacgaaaatgattttaaacctttcaaatctgacatgaacgaactgcggaatgatttactacgttacttgacgatcagcgctacggatgaggaatggggaatcgtcgtcacgacggtcggatatcaattcatcccgccgggttgcgcctatccactttcccggcatccggagaagtataatttcaagcctcagaccgggcgcatcctgaatgagtatcaattggtatatataacgaaaggtagcgggtacttttcctcccagtcttgtaaatcgcaaaagataaacgcagggacgatgatcctccttttccccggggaatggcatagttattatccggaccgggaaacgggatgggatgagtattgggtaggttttcggggtattcatatcgataaacgtgtggagaagaaattctttaccaaggaagagccgctacaccggatcgggctgagcgctacgatcgtcggactttatgaggatatactgaagttcgcctcggaggagaaatccggttaccaacagatgatctccagtatcgtgcttcatatattaggctccgtatattataaggaaaagaacaactccttcacgaacacctatgtcgtagataaaatcaacgaggcacgtatattaatgaaggagaacatcgaggacccattaagtccggaagagatcgctgcccgtcttggtttaggttattcatggtttcgccggatgtttaaggaatacaccggcgtctcccccgcccaatatcaattacaacagaagctccttcgtgcgaaagagcttctgactagcacccctttgacgatctccgagatcgcctatagcctacatttcgagaatgccggccaattctccacattcttcaagaagaaagaaggggtcacgccctcggagttcagggatcggacgcattgagctggagtgaaccgctcaataaggtttataaggcgtacgcatgacattccatgtttttggtagccacactctataacgttctgcctgattccacgtattaccagctgatgcgaaatcgcacagatgaatcgggcgagccttgccgtttccttccaaatccgttcctaaaaccataggaacggtaaaagccatccaagcgaaatcgggggcttgtaccggagttaattccacataaccatccttgctgacgatcacggaagcctcatccacatctccatccttaaagcggctatctctagccagcaccaaagggcctcttacgatcgcttgagcctcgttcagctccaccaagcgagcccgcatatccaactccaccgtaatttcatcccctttctcccaagtcctatgaatcggtaggtatgctccagccaacagatccgttaaaggctcaccattgacagacaccacagttcgctcactccacgccgggatacgcaaggcgatcgtaaaatcactcgtcttctccggttccaccacaatccggacttgcccatctatcgggtagtccgtctcctgcgtcatcgacaccctcgtctttttatccaactctacctccacgctcgaagccgcatataggttgacatcgatacgtctaccgtttacctgataagcgaaccgcggaatcatcgcgaaagcacgaggtccattcgcattgcaacaattgatatgcataccgcattgctcctctccttcatgccgccagccctccaacggactgtatttcgctatttgagaggcatccgctttcagcgaggctagtaaagcgttatacatagccttctctatctggtccgcatataaggaatttccggttagtccgagcatcctgtcacaaatctgcatccacgtgaacgtcacacaagtctccatcgtatgataagtaggataagtttgtaacgccttgcccccataccagcactcgaacgcactaccggaaccggccacattgatttcctcattgataatatgattcatcgttttctccaccacagataaatataatggattcttagtgaccttgtaaagttccaacaagccctcataacaagacatcatctcatatgctttttgtccattctccggagagaaccaaacctttggatgtggaaaacgtccggcgacaggaatatccgcaatcgccttactaatcaatcgagggccttccggagtctcccattgctttacgatgtacttggcaaaatccagatatttatcttgccgggtacgattatacagatacatcaccggctcaagtaccgaagagcttggcattcctatataattaccggtcgtcacgatattcacttttccgggtcccacctgcgtcatcaaatggtcgatcacccggcaggcggcatccaaagcttttcgatccccagataagtcataataagcgatcaaacctaaagccgtgtattttcgcccccatatatcccactggttcaactgtgcttcctcggaatagttaccgatatatccatttggcaattgggtttccatcaacaattccgctccattcttaataatcttgtacaactcaggatctttatcataacggtatgaggcgatcgccccttgtatccattttccccaaaattccgattgccagcgcgaggtctcttccttatgccggaaaggttccaccaaatgatccacatcttgagctttcactcgatactcgatacaagcgtcgatccgttgccccaaataaccggatatcctcaagtgacgtacaggatcagtgtttcttacttgcgcattcatacaacaaacacaaaaacaaaagaatagacacgacatgccttttgttaatacggatatactcataaacacaattcttaaggttaataaatgtgataaagatagcacattccacttgttcggaactttcagaattgacaaaataaatatgaatattgacacacaaatcgtatcttaaaataaaatatctattatttttcccctgatatattttgtatgaatcccagtaaatacatatttttacttcaaaaaaatttaagttatgagggtcatttatcttttactatcttttatgctttgtttctaccctgtcacacaggcgcaaaacacgacgaatcaatttatgacacaggcacaaagcagcctggaaaaaaaagactacaccaaagctcgttatctttttttacaagcttacaagagcttatcccaaaaaggtgattacaaacaggcgatcgatgccggtacgcaggcggcttatctatattatcgcgagaattattaccaagaggcattcgatctttgccgccagatgaaccaattcatcttaaccgaggaacagaagttgcagaaatcgctctatgagcaacgcttccaagtaacgaaagagcggttggaaatgtatattaagctaaagaacgccgcccaagcgcaagttcaactcaatacattagataatctggccagccaagcgggcgatgagaagttatcgaacaatttattatatacccaagcaggttattattatacgttcgggcaaaacgagcagggggatgctgctttccagaaactgatcaaccagtataaggagaaaaaagaatatgagaaggtgaacgattgctaccggaacctgatctctatcgctcgtaaggcaaacaacgccccactgatggaacgtacctacgacaaatacatcgtatggacggattccgtaaaggctcttacggcagaggataaactaggggcattacaacaaaaatacgatcagagcctacagacaatacaggagaaagacgataaattgtctgttaagcaatatatgattgtcggacttatcacattcgtggtaatcctgatagccgccttgcttttcttgggattccttctattacgctttattgtgctgaacaagaaattaaagaaaatcatccagacgacaaacgagcatagcgaacaacaagcccaattcatccaaaacatatcggttcagatggagcctaccttgaacaagcttagcgcatccgccaaagaattacaggcggtagctccgaagcaggccgaggatgtatggacacgggtagaggctttgaaacagtttacggttcatatccaagagctttcctccttggagaatacgttgatggaaccgtatgaggttagttcttttaatgtaggaaacttcagtaagaaaatcgtggagaaggttaaaggggatattcaaccggaggtcaatctcgtaacagacgtgccccaattggagattaagacgaatgccgagcatctggaacaagtcttattacatttgttaaagaatgccgcattatatacttccagcggtaacatccgtctggattttaaacggaaaggcgctcatgtttgccaatttatcattaccgataatggtacaggcataccggatgatctaaaagagaacttattcaagccattcaatgaggcgaaggatctagcgcaaggcgatggtttgggattacccatctgcgcactgatggctagcaaattaaacggaaccctatctatcgataaggaatataagaagggatgccggttcgtcttggtattgcagatataaaatagactcaccttgtttgtctttttaccgcgatgcggatgcagtgacgctgcaatccgggttgcagtaacactgcatccacatcgcggtatcactgcaacccgggttgcagtagcttattccggcaaatgcttccgtaagaactcaatccagttaccagaggcgatacggttgatagcatcgtccgtaaagccacggtattgaaggatcgggaatatcttttggagatcggcgatcgttattaggtcatacgggcattgctccgtaccgaaagcaccatccagatcactgccgatagccacatggttcgcgtttccggccaattggcagacatgatcgatattgttcgccataatctccattccacagttcatgcctcttggagtagactcgcctcgcacccagttcggtaccatcatccaagcgtctagggcgataccgatcacggcgccacgctctatcaacgccttgatcatctcgtcgctaaactggcggttgtgatctacgaaggcccgacagttgttatggctcgcccaaataggtcccttatacaaatccaacgcatcccagaaagcctcatcacataaatgggtcacgtcaagaatcatacccaagcgatccatggtacgcaacaactctttccccatggcattcagatgaccggtagaatccgtaccgttggcatatcttccggggccgtaatgtgccgggccaaccgccctcaagccataagcatacgccctttccacatgattcaccgtgatgaacgagtcggctccctcgatacttaatacataaccgatcggcttcttgtcggcgggttcaccgtctttccaaagagccagatgcgtatccaaggccttcttatcccggatcatgaccatctggccctcctcttccatcgccttataccaagcaagttggccttgggtctgcgcccaagcttgttccggggaatgccaaccgggaagtggattatccggccctacatagcgaccgatctgggtggcgactactaacccgacgtttcctttacgcagttcctcaaacgatatagtggcgtttccacggtcgggcttatcggtcataccgatttctctccggtttatttcctttaggggttgacacaaatcccggttccactccaaagcgttcatgctaaggtcgagatgagcgtcgataataaatggcttattcattttattaattgagagttgataattgataattgaaaatttgattaccgttaataggtgatgcgacgtgaacgggcaatgataggccattcgccgatcgcctcacgatcccggatcacataagccttgtcgtataaagcgaccgtaggacaaatatgaacgggaatgccatagaatacggaacctaatggatagagccgactgtccgggacttccaagaccagatgctcctcgctctgggagataggtttcgcctccggatggttcaagaaaaacacacggggcaaaggactttccgaggctaccgccttgtaaccaagatctacgcaaacatgatgctcatccagcacggaaatgacccgagttatcaataaggcagctaccttgaacggcatatccggataagcgtttccatacccccaatcccagaacacaaacgtgccgggactgcattcgcaatccttccgcttcgcgtacatcgggaatgtaggagtacctcccatcacctttaccaatggataggcaaacttgcgggatatctcccggaacacacgttcggtcaaggcgtacgctgcatccgcgccttggcaacgtaccgatagctccgcgtcatgtatatgtccgtcgtagccatgcaacccgataatccgcagagacctcaacggtaggatcgcatccaccagcgcctccgctctctccgggaggactccggtacgattcattcccacgttcagatcgataaagacatccaaggtgatattcccggcctcgcaaagagccgagatcgcacgggcattctccgcttggtctaccaagcaggagtaatgggtggcgggatatgcctttatcaaatctaataagcgggaaatcttcgggcctaccggctgataggctaataatacatcgggggcattcatatgccccagcatctcggcctcggcaatcgtagcgcacttgaacttccggattccggcatccagcagcatacgggatacctcagccgccttattcgtcttcacgtgcggacgaagccggttcgtatcgcctatgatcctcttggccaactcgatattgccggaaatacgatccggatagaacgccaaggctggcgagtctatccggtctacattacttatgacgtaccaatcgtccatggcttattcgtataattcgaacaaagcctctatctctacaggaatattatcgggaagagaaccgaatcctacggcgctacgggtacctacaccgttatccggcccccatacggcggcgaacaactcgctacagccattgatcacataaggatgctttccgaaatcgggcgtacaatttaccatacccaataccttgatcactctctttatcttgttgaagctacctaaattcgccttgatcgtagccaacatcgtaaggcctacttgctgggcggcgagtttgccttcatccatcgtcaagtccttaccgatacgtccgatgatcaaggatttatcattccgcacaggcccgtgaccggaaagatacaggtatttgccatctatcacacaaggcttgtaaactccggccggagccggtgcgggaggtaaggtcaaccctaatttctcaaaattctcatctgcgttaatcatgctcataatttctttcatttatatgttagtaaaaaatatattgatctatttcctgactctttccgttaccggttgattcgtggcgacagagattccttgtagctctacatactcgacgcttaaaggattcttagagctggctttaacgtagagggactggagaatcgcctgttggttgttgatcgttatgtagcatacatagcgggaatcacgtttggtaatcgtcaactggcgggagggataagcggtcaatgagcatacacaagcattatcactcgccgagatcagtttatacccataagccattttccgttggatatagctcaagccattggtttcccccggatgcttttcccgattgacccaataaacgttcaagggatcatgtgtatccagcttaccatccctcagattcacatcgtaacaaaccaagttcttattcacgcttcgtgctatatgaaaaagcctcccgaccgttggataagtaccttcctccgggtccgccgcaaacgaggcgacgaaagggaaaagcataataacgatactaagcagccatctctttctcattgctcaatcattcttttgttatacaatcatatttaagatcattaccccgatcaatcctacgaccgacacgatcgtctccatgatagaccatgagcagatcgtatcctttatgcttaggttaaaatattccttgaacatccagaagccggaatcgttgacatgcgagaacatcaagctacccgctcctaaagataaaaccatcaagttcgggttcgcacccgtttgcgtaactaaaggcatcaccacgcccgccgccgtcaacgccgccaccgtagccgatcccacgcacaaacggatcacggcagagatcaaccaacccaagatcaacggatgaacgggcaattgctccagacttgtcgccagctcattgcttaccccgctatcctccatgatctgcttgaagataccagaacccgcgatgatcaaaaggatcatagagatatctttcacggcctctccatagactgccataaccgacttgatactacgtccctgccggatgcccagcgtatatgtagcgaacaacaaggcgatcagcattacaatggaaggagcaccaataaaagagactatcccgctcgccatctcgcccatatccttaaagcaataaggaataaccgtcacgataatcagtaaaaagacaggcaacgtagcgctgataaaactattcaccttgcccggcataccatatctcccgctatcctctttctgctcgaacaacgtgaccggaccggattttatatgtttcaaccgactgccgaacaccggcccggcgataatgatagccggaatcgccaaacataaaccgtagatcagcgtaaggccgatattcgcattgaattgtaccaccaaggctaccggagacggatgcgggggcaggaatccatgcgtcacggacaacgccgccaacatcggcaacccgatatagaccgccggaagcttgtatttatacacgatcgagaagatcaatggcaccaacaacacaaatccgatcccataaaataacggaatacccacgacaaagcctgtcaccatcagcccccattgtatatgcttagtaccaaaaagcgacaccatcacggaagcgatcttctgtgccgctccgctctcggccaccaacttgcctagcatagcgcctaatacgataatcaacgtcaacccacccaagatactcccgataccgttattcaccgagtccggcagcttctccaacggaatgcccaaagcgatgcccgccaagatagaggagatcagaaacgcgatgaaagcatccaccttaaagtaggatatcaagacaatcaataaggccaaacaaagtacgacaatgataaatgacatgttttttcgctgtattagtttataatccgtaaacgggatacaaagaaaacatttatttccgaactacccctttttacgataactaattaccgctaacagattaaaaaaaacagcaaatagacagacaatcacaaaatgtccccgtaaatcggcaaagccgctcccctttaaatagaccatacgcatcatctccacgaaataacgcaccggattcgccagcgtgatcttctgcgcccattccggcatactgctgatcggcgtgaacaatccgcttagcaaggcgaaaatgatcaagaagaaaaacgccgtaagcatcgcttgttgctgtgtggacgagaaggaggagatcgccaagccaaatcccgtaaaagcgatcaaatatacggcggcaaacaaatagatcaccccgaaactcccctccggcaccaagccgtagatcagccaagcgatgaggatcgccaccgtcagcaggacaaagcctatcacccagaaagggatcagcttcgacagcaggaacagggacttgggtacgggcgagacgtttatctgctcgatcgtccctttctccttctcgctcacgatattcaaggcggagatcgatcccccgataatcgtcagcaagaataccatgatgccgggaaccatatagatcttgtagctcaagtggggattgaacaggttaatcgaagccactcccctgcccgatcccatagaggcgaagcctttctccctattgaaatcctgtataatcgaggagaggtaggagctacccaagccgcccttggttccgtttacggcgttagcggcgatcatcacgtccgccctgccctccttccccaagtcccgctcgaaatcagaggggatttccagaatgatatcggactcattgctctccaccgaggtcagcgcctcgtcgtagcgatccgaccggtctgtcaggcggaaatatccggaggatagtaccttatctaccaattgcgtggaggtgacggaatgatcgttgtccacgatgctaaggttgatatttcgcatctcgaaattagcggcgaaaggcaagatgatcaactgcatgatcgggataatgaagataatcttcggcatgaaccggtcccgacggatctgcttgaactctttctctaacaaatatcgtaacatagcttataatcgtattttaaaacgtttcacactcaagaataccagcacgaccgccatgaacgacagtatcccgatctccttcaagatcgacacggcgggaagccccttgatcatcacgtccttcacggcgatgatataccatttggccggaacgatatgggagaaccattgcaggatatccggcatattctctatcgggaacatcatgccgctcaacaacatgatcggaagcatcaaggcgataccgctgatcaacatagccgcctgctgggtatcggctaccgtggagatcagcaggcccaggcagagggatacgatcgcgtacaggatggacacggaaaccagcaacagcaggctgccttttatcggaacgtccagcaggaaataggatagcagcaagatcgtagcgatattcaccatactcagcaataggtatggaatcgccttggccaaaatgatgtagatgggtttcaacggggagaccagcaggacttccatcgttcccatctccttctctttcacgatgccgatcgaggtcatcatggcacatataaggatcaagatcaaacccattacgccgggcacgaagttgtaggcacctttcatttgagggttgtagagcaaagaggtaaccggggtcacggctttaccctcaaccgccgactcgcctttcaactgttccgcgatgatcgccgagcaataggcgattagctgcgtggcctcgttcggatcggtagcgtccgccaagacttgtacttgggcatcggccgtggaagcgtacccgggggggaagacaactatgacgtgtacctttccttgccgaaacaaggccccggcatcctcatagctatcgacggtcgtatacagctcgaagtactcgctggcattcaagcggtctgtcatcttcagtgtcagctcatcccggctttggtcgaaaatagcgatcggcacacgcttgatctcggtcgtgatggcatatccgaacaagatgatcaggatgacgggcatgagcaagaggatcattgtcgtgcgtgcgtccctgaaaatgtgatagaactcctttctaacaaaggatatgaattgtttcatcgtttattctcctctcgttgcttttcgagccaaggcgtggaagacttggttcatattcgttgtcttaaaatcccgcttcaaggcggagggactgtctaacgcttcgatctttccgtctaccatgatggagacacggttacaatactccgcctcatccatataatgggtggtgacgaagatcgtgatcccccgggcagccgcttcatagatcaactcccagaactggcggcgggtgacgggatcgacgcctccggtaggctcatccaagaaaacgatcttgggctcatggatgatcgccacggagaaggatagtttctgcttccagcccaaaggcagggaatctaccaaggtgttccgctccttttccagcccgaggatatccagcaactcatccgttttctgggacagctgccgcttggacaagccgtagataccgccgaaaagacggatattctcccatacctttagatcgccgtatagggagaatttctggctcatgtatccgatattccgtttgatggactcgctctcccggtagacatcgaaaccggctacccgggcctcgccggatgtcgggaccgacaggccgcagagcatacgcatggcggtggtcttccctgccccgtttgccccgaggaagccgaatatctcgcccggctccacctcgaaactgatatgatcgacggcggtgaaggtgccgaaacgtttggtcagttgttttacttctatcgctttcattttttatccttatttcataattacaatgccgcatttctccaagattcgacctcgcgcccaacgcgagccccgcatttcccctctcttacaaggccatgaaacaatcctcaacgcttggctcaaggcgttcgatgcttacgtccgcgtaacctttgcctttcagatattcctgtaatcgcctcatgacatcctccccatccctcctcaacgtaagatgatgagcatctccaaaagcgaaacacgagtttgtatccgggaactcccgcaagtctcccaacaacttatacatcgatgcgcatcgcaccgcgtatagccgcctatcgaatgaggtacggatacctgtcggcgtatcgatagacaggcattccccggaacgcaccaaagcgatacggtcgcaacgggaggcctcatccatataaggcgtagagacaagtatcgtaatgccttgccgtttcagacgatccagcatatcccaaaactcagagcgggagacaggatcgacccccgtcgtaggctcatccaagaacaagacatccggacgatggatcaaggcgcaactcaaagccagcttctgcttcataccaccggacagcttccccgcccgccgatgcttgaacggctctatctgcctatagatatcccgtaccagatcgtagttctcctcgatcgtcgtattgaagaccgtagcgaagaagttcaagttctcctctactgtcaggtcttggtagagcgagaagcggccgggcatatatcctacccgccgacggatctccttcaagtctttcaccacgtccaagccgcagacagaggcggtaccgctatcggccagcaacaacgtggtcaggatacggaacagggtggtctttcccgccccatccggaccgatcaacccgaacaactcaccggagccgatctccagcgacagatcccgcagggcctcgacatcgccataacgcttggtaatatgatttatatgaatctcgttattcatatttaatctccccatattgcccgatcttcagataaccatcgttgcggacggcgatcttgatggcatataccaaattagcccgttcgtccttcgtctggatacctttcggggtaaactcggatttatcggagatccacgtgatcgtaccggggtattcccggcgatcattcccatagtcggcgaagaccttgagagattgccctagtttcaggtgggataactgatccgccgtcacataggcacggagataaagcaagtccgtatcggcgatcttgtaaagcggtttgcctgccgccgtcacctctcccggctcggcgtatttcaccaataccgtaccggtctggggattgaggatacggcttttcatcagttgatcatccaattgcatgatctggtattgcaggccctccgcctcggcgtcggcacctcccgtcgtcttgcttaaggaggagtattgggcatccagttgtttctggagatatttgatgttattcacgatatcgtccagttgcttttggttacccgctttcgcacgcaccaagttttcctgtcgctgttgctcggtcttagccgtggcgatttgttgttccaagacagcgatctgcttacggatatccggcttgcgaatatctaccgagcgaaggctggcagagagttgcatcttccgcagaaaaagctgggtgctatccacgtaacccacgatggcgccggcatccaaacgatcgccctcctcgatattcagttccatgatctttccgttggcttccgaagataccaagatctcggttgcctcaaaggtaccggaagcgtcaaaatcattgtctgtattaccgcaagccgtccatagaaagctgcataagctgataaaaatcaaatgtctcataaatcaattgtatttgtcatactctatttaattcgttgtatacatataattataaatggtcatcaagcgctgtacacggtgtgccgcggcggtttgccgggccatgtcctcggcgttgatctcccggattaggtccgtgacggaaatcacgccattctccagcttcacctccgccgcctgcttgatgcttgttctcagacggatgatatcgtcatcggcacgcatcagatccgtcattttctttatctccgtgttttgctgcaaaagttgcaggcgggtattgaataagaaggtctcccgttgcacatcaatctggcgacggcttacctcgatcttcctccggtcgttcttcagcgtgtacaacttccccagattccaagaaagacggacaccggccacataataaggctcgaaactatcctccagcatgttcaagcccggccgaccgtaaccaccttgtacgaaagctccgatacgaggcatcaagcccgccgttacctgcttgttttgcgtctcgatccattcgctcttagcatccaaggcccgtaattccggacggttgatttgcgtggacaatgaacgctcgggtgactccggagtcttcaagaccacttgatccgtcagcggtttattgataaaggtcgccaacatctgccgatatgccgtgcgagacgctcttagctcaatctcattttggcgggcattcagcagttccacttccatactttccagatccgattgattcgccacgccattgtctatcatcgccttgatacgctcgatattgacctgcaactccttttgaagcaaagcgttctgacgtatcaactcgtcttgcagcaggcaaccgaagtagatttgattcacccggtcgttcagcgcatacaactcactttccaattgctcccggttggcgatcgcctcggcacgagtcaaggcacgggccgaacgggtgctaccgccgtcccaaatcgtctggtccacctgcgccacgacttgatactgatccttgctcaagctagggatctcaaagccgggaagaagcgaggagatcttatcgccatccaaaggcaacttcgtcacgtcgctctgatagcttgccttaccgcttaccgaaagctggggaagccaagccttgcccacattactcaagctataacgctccgtctgatcgatcaaacccatttgatgaatctgcggataattcgccctcgcccactcgtaacactgggtgatcgtgaccgattcctgtccgctaacccttccggcataacccaacaggctaattaacaataatacatatacacctctcatatactctatgatatgtttattaaattgaacaaatccatcatctggcatccgggaccatcagctgggttattacctcgacgatcaaatccctgcgcctatccatatattcctcaaaccgccccatatcgttatccaaaaaagccgccgctagtggcttgcggatcaacaacgggaagaccactaggctcaccaaggtcgaaaccaaatctatgaccggcatcttccgtagaagccccttgtccatctcctcctctatctgacgacgaagacgcaagatgggctgtatttttttcggatctttcagcacggtctggaataaacgttccggatctctatttaactcgcctaccacaaaattcgggaacatcgggttcgcacgaacaattcccatatacagatcaacgatcaccggcattttctccagcatcgtactcttctcatccaaaacccgatcgatgttcggcaacaatgaagaaagcaattgcccgaaaatagcgtcgaacagaatctctttcgtcctataataataatgtaaggccgtcctgccaatacccacttctgccgccacgtcactcatggtagccgcctcgtacccctttcggacaaacactcgcttcgccgcttctatgatgcgaggctccatctcattcatgtctttcgcttccataattaaatgttattttttgttttgtcactatcgtttgtcattatagtttgacacatgcgtcaaaagtagtataaaaaaattacatagcaaataaaacctaagttttcttgctatgtaatccttcttaaataattattgaatcgtgcgagcctcaactccttcggttgtaatctccacgggattgatcaatccctcctcgttgaacgtcatcttctcgatacaagtctcccggtggtcacgtgtcttgaccccggccggccggcgatggtacacgatgtagtaatcttccgaattcggcacatgcatgatcgagtggtgacccgctccgttggcgatatcgaaattttgccgcaagacctccccgatacgattgaacgggccaaaaggagaatcggagatggcgtaagcgaccttgtaatccggtccggtccaaccaccctcactccacatgaagtaatatttaccattcttcttaaacataaacgggccttccacgtaatccttgggagttacctctttataaatcgttccgtcctcgaacggtataagtccggtaaagtctttattcaagcgtaccatgttgcagtgtttccaaccaccgtaatacatataatactcatcattgtcagcgtcgtggaaaacaaactggtcgatcggctgcgccccattcacgatctcgttgatcagcggcttacccagcaaatccttataaggcccttccggacgatcgctcacggcaacaccgatacctccgatctctccctcgtgcacgtcattcgccccaaagaaaagataatacttaccgtccttgttgattaccgaaggggcccacatagcgatcttcgcccatttcacctcagccgtatcaagaatggcggtatgcttggtccaattcaccaaatccttagaagagaagcaatcgaagaaggtttgcttctcatataaatcactcgtagtcgggtaaatccaataggtatccccgtaaataattccctccggatcggcgtaccaaccctcgaatacaggattaccactcttcgctacctcttcgcttggagcctgtttaggacccccgcaggacatcaaggcaccggccatcaatactgtgtaaaacaggcttttctttccgtttatcatcaatagtagattatttattagtaaatcaaatagtatcttttaattattcgagttctccatgttcttcgccaaaccaccttccgaggtctccttataaagactgggcaaatcattacctgtctggcgcatcacctcaaccacctgatcaaaacttacccggtgttttccgtcggagaagttcgagaacgtattcgcgtcaagcgcacgggcggcggcaaaagcgtttcgctcgatacaagggatttgtaccaagccacaaacaggatcgcaagtcaatcccaagtgatgctccaatcccatctcggcggcatactcgatctgcgcgggcgtaccaccaaacaactgactggcggcagcggcagccatagcgcaagccacgccaacctcaccttggcaacctacctctgcccccgatacggaggcattcgtacgcaccacatttccaaacaagcctgccgtagccaacgcacgcaatatacgggaatcacggaactcacgcgtctccttcaagtgataaaggaccgcaggcattacaccgcaagaaccacaagtcggagcggtcacgatcttcccaccgcacgcgttctcctcagacaccgccaaggcataggcatacaccattccccggctcttgatactgctgccatagcctttcgcacggatcatataatcggaagccttacgacgaatgcccaaacctcccggcaagatgccttccgcttccagaccacgacgaaccgcatcctgcatcacttcccatacctcagccagataatcccagatagaagggccttcgtgctgctcgacatattcccaataggaatggccagtcttctcacaccaagcctgtatctccttgatcgtatgcatatcgtatacttgctctgtcctcaactcattgaaagactcgttcgccaaggttcccccgccgatactatatacggtccacgtatccagctcctcgccactctcattatacgactcgaacaacatcccattcggatggaacggcaagaaagtcttgggttcccaagtaatatttgtcttcgcgaccggctgtaatacctcaagaatagctgcgtccgtcatatggccttttcccgtagccgccagactaccatataaggttacgttaaaacgaacagcgccccggttacgttccaagaacatttgtgccgcacgcatcggccccatagtatgactgcttgaagggccatgacccatccggtatatttgtttgattgattccatctttcttcgatctaagttttcttgtttctatactttaaggaaaatattatgtttataaaacgcatacaaaagtacataaattaccgatacattgcacatggcaatgagcaccggataataatttcctaaatattgctgggttccgaaaaacaaggattcgccgatacacctaaaacttaccacgttagtaagcatataagccagtattgaattcatgccgtacactttcagccaagtcgtatactttcgatgccctttatagtcgatccaataatagaacaaccccataagcaagaaacagtacccactgctcaccaataccatcgaactggtccacagtttcttaataacgggaagctcgataccccaaagccatccggcgataaccatacccagaccaataccgaataacatccgtaatttgagccgcacggaatataatttgttctttaggatatatccggcgaacaacccggtcaacacggttaccccgaaattcaagctgctcagtatccatgtataacgataccaagtagcgaatatcacctccccgttctcccccgtcgccccatcccggaaacgtcccagtacggtgcggtcgatccattcggccaaattactatccggtgtgtacgaacctcccccatagttaccgactgtaataaactccatcgctccccaaaagattaataaaagagctgccgctataccgatctgtacccgtatccttacatgcaagaataacaaggaagcaatcaaataccccatagcgatcgactgcaaagtatttgaatacagataaacccggtccgggtccaaagccaataaattaccttggcacatcataccgaagacccaaagcagtaccacccgtttcccgatccgccgatataccgccatcttatcgggcatatccttataacgagacaaagagaaaggcatggaaactcccgccatgaataaaaataagggcatcacgagatcccacgtagagaatccctcccattccacatgcgagaatccccacataaaagaattaaaccaaggcatatcaatcgcatgggccagcggatgcaacaccatctccaacaccactaagcaaaaaaggtcgaagccacggagtacgtccaatgactccaaccgatttaatttcttcttctccatccgtctattatactttcaagaaaatacgttggcgatataagaaatacaagaacccccaacaaacagcgatatatgcgatagcgctaaccaaaggctgggcggtctcgggcatcagcttcgccaaccctccgaatatagcctcggaagtataggagaaacgaataaaacgctgtgccaaatagatcgtaatagagttcatgccgatcacggtaaaaaacaaggtccatttacgccaccccaatacatctataatatagaagaacaaagcaaacatccaaacggaataagcacctactacacagacaaaagagcttgtccatagcttcttattgaccggaaagaccaagctccataacaagccgacgatcaacagcacagctcccgcacctaccaaacaaagcactttctttcggtcggtcagcccctctttccgtaacttgatccattcaccggtgaacatacccagcatcgccgtggcaatcgcagggacagtggagaataaaccctccggatcaaaaacaatctcgtgcaaacgtccgggaagaaacaggcgatcaatataccccaccaaatttccctcgagcgtaaacgaccccgctccaccggcatccggcacaggcacaaaagccatcgccagccaatagccgaccaagataaaagccgttatccccgcacgcactttccaaccgaaacggacaaacaacaaggccgcaaacatccatcccaacccaatacgcgccagcacgcttgcgcaacgcaggtggtcaaattcaaacgacaatagtccgttatataccaatcccaagaaaaccaaggtaatcccccgacggacgatcttcttgtaaatcgccccttccgtcataccttttcctcgttgcttctctagtgagaacggaaacgagatacccgcaataaagagaaacaatggaaagatcgtgtcgtgatgcgccaacccgttccattccacatgttccatctgcccggctatcgcctgaaaaaaaggattcggaaacaatgtcgccaaagcgacaaataaagaagcaccgcccataataaagagcatgtcaaaacccctaagggcatccaatgattgcaaccgctggggttgttgtttttgtttttccatataatctatttacatttaaagtcaacacaaatataggaaaactcgctcatatacggataggatttgacataaaaagacgctcctaatctttctcctcgcatttagcctccaatttttcggcgtacgcctctttcctcatcagatatagatgaataaaaaggagttataaagttcagaaaaccatagcgaacctcttcattgggaaattcgagtttataaagtttaaaacggggatcatactcctttatggtcaaatatccactctgataaagaagggggatcggattattccgttccgcacggtattcggtaaaggccgaagcttgtgtctctacgccatcaatcaggatacgcagatcaaactcgcttttctttaataattcgacaagaaacgtaggcgtaccggtctgaaaccaataatcgccaaactctctcttccgcaaggcactcaatgcgctaaatggattaaagacaccttctcgactcggatgaaaatgatacccgtcatattgccgcaccattgtctccacggtctcttcccttgataaggactgcatctgtcccaactgctctaattccggtgttagattatcgaccaactccgcatgggtaatcccacaaagtgtcgcatagtcatagtctaaacttatatcattgagttggttcaaatcactgaaaacactcacctgcgcaaatttggtaactccggtaagaaagacaaaacgtaaataacgatccgcactcttgagcactccataaaacgctttcatgatatgtcgatacgcctcttgcaagggttcgttatgaatcgtttgcaaaagaggtttatcatattcgtcaatcaagactactacttgtctgcccgtttgttcccatgcacgacgaatcacgtaaaaaaaacgttcttccggagctcgcgatttcatctcatcgccgtaatcagcctcccacatttcaagatattggttcaatatagccaccagatctgcctccgactcatatttgcgtgcgttcaaatccaaatgcaataccggataaacattccaatcctgctctagctgatcgatagccaatcctttaaacagttcttttttcccttggaaataggcatctaacgtagatatcaataaacttttcccaaaacggcgaggacgactcagaaagtaaggcttacctttcgtcaccaattggtaaatcaaggcagtcttatccacatataaatagttctcattccgaatattttcgaaactctgtattcctatcggtaatttacgcatagtcgtcataaccttttttcttaccacacctgttgttgaacaaagatagaacttttttccggaacaagtctccgattatagttttcattctatgaaatactcaattttccgcaataaatcactttagattaaaaaggaaatcaaaatagaagtatctcctttaagcatgactacgatatcgtaataggccctatcgcagatgatggggaaacatatcttctaagccgttatgaggaaggatcatttacatcagggcaaatggccaagaatttagagtacaagaggctgaataaacaattctattttgattttgggacacaacgtgctatagatttactaaaaagaacacgatgacaaagcaacaacaaacagatttccttatcgctcatatctttgataagacgacacaatatctaatagaggatttcaaactagatatccctatggctctcaatctcatatataactctaaagtctatgagcttttattagacaagaagaatggtctatacatccaaagtccatcatatatctatgacttagtaagaaaagaatatttatttggaaggttctaagggctatccgtttcgatctccatacccgatttgtgtaagaaaagggcaatattctttacttcccataagcgaaaagtaaagaataccgccccttgtttatcgaaagaccgctgtctatgcaagtctacatactcaccttgccttcaaaaaaaattaatgtcaacacttacttctgaattttaatactccaagtatcccccaatacatcgtatataagatcgatttgaatagtccaagtctttgatagtggtaataaaaagggaattgagcctttatcaactttttcttcttcccagtggtaaatgaagaaatgactcggcaacctactaaagcattttgaataaaacgtttacaaacgtattcacagatttattactccgctctcatgggattatttataaaatcctcatagcttaaacggataccttcttctaattctgttttataagtccaacctaactgagtggctttcgacacatctagcagtttgcgaggcgtgccattagggcgagatgtatcccatagaatatcaccttcataacctatgaccttcgccaccaacttcgctaactcttttatggttaattccttacctattcctgcattaacagtttcattaccactataagtattcattaaatacacacagagatttgccaaatcatccacatacaaaaattctctgagtggagaaccatctccccaacaagtgacagaggagagcctagcttctttagcttcatgaaaacgacggatcaaagcaggtaacacatgactatgttcctgatgataattatcatttggtccatacaaattagttggcattacacttatgaaatctgttccatattgtctgtttaaatactcacaatacttcagtcctgcaattttcgccaaggcatacgcctcattcgttgattccagagatccagtcaataaacatgattcagacataggttgcgatgctaaacgaggataaatacaacttgagcctaagaattccaatttcttgcatccatttttccatgccgaatggatcacattcatctctagtatcatattttcatacataaaatctgctaaagctgattgattagcaataatacctcctactttagcggcagccaaaaacacatactctggtcgttcttttgcaaagaatctctctacctgctcttgacaacacaagtctaattccgtatgagtgcgagtaataatattcacataaccttgacgctgtaattcacgtacgatagcactccccaccataccacgatgacctgccacataaatcacactatctgtttgcatgacagcttattttataattcccttttccaaatactcaaccaagttcatacgcacattctcttcagcacgctccactgcaacttttgccatatcatgatcgaccataatacgcactaattcttcaaaacaggtcttccttgaaggatcccaacctaatttctcttttgctttgcttggatctcccaaaagattcacgacatcagtcggacgataaaaatctggagagatttctaccaatactttacctgtagctttatcaatccccttctcattttccccctcacccacaaattctaattcaatgcccgcatatttgaacgccaaatagcaaaattcacgtacactgtgttgtactccggtagcgatcacaaaatcctctggttcttcttgctgaagaagtaaccacatgcattccacataatctttcgcatatccccaatcacgcaaagaagaaagattccctaaataaagtttctcttgcttaccctgtgcaatacgagctgcagccaatgtgattttacgagtaacaaacgtttctcctcttcgttccgattcatgattgaataagataccagaacaacaatacatattgtaagcttctcgatactctttcacaatccaaaaaccatactgcttagcaatagcgtatgggctatatggatggaatggagtattctcattttgaggtacttcttctaccttcccataaagttctgaggtagaagcttgataaatcttgcaagtatcagccagtccacactgacggactgcctctaatacacgtaaaacccctgtcgcatctatatctgccgtaaactccggagaatcaaaagaaacctgcacatgactttgagcagcaagattgtaaatttcatttggacgaatcttgttaatgacttggatcaaactcatcgagtctcccaagtccgcataatgaagatgaaaattagacttcccttccaaatgagcgatacgttcacgaaaatctacagaggaacgacgaatcataccatgtacatcatatcctttttctaataaaaattcggctaaaaaagaaccgtcttggcctgtaataccagttataagtgctatattattcatttactctatcctttgttttcttcattagaattatataagtaaaaatatacctttatagtcttttgttatctaaacatataacgtacgcaatcttctgttgcatgacctccaatataagtgaatacgttttttaccatatctctagtttttttacactgctcttcataatccataccctttataagtttaataacttcatattcattcatttgaaccccattaggcatatctttaacaggattaaaatagagtccccgatttttactatatgtgtcaagatcataagcaaaacatataataggtctctctaaaatagaataatctccgatacatgctgaataatctgaaataaggatatcactcactttaaataaatcattaatatttgaataattactaaaatcaagaataaagtcatcaaattcaatacctagtaatttatttgtataagcatgagtacgtaacagtaagatgtaatcatcttttagctcatttttccaataattcatatttataggaggttttatttcgtatgatcgtcccatatctatactatccctccatgttggagcatacattataatcttcttattaagtggtaaccctattttcttcttaagatcaaagatctcttttacagttgtcccatataaagaatcattacgaggtaatcctgtaggaataaatgcttcatctcttacttttaatgcccgttttaagatagaacgatgataatcactttcataacaacaaaaatccacatttctccaatcgtagtctttgcgtccagccgcatcattcccaatgcaattaaaagatacaccatgccaagtattcaaatagagttgatctttctttttaaaatgtaaaccacgctctatgttcacacaagcgatccaatatttagccttaagagccaccttgaaatatgcccatgtatctgattttatcttgacagggttattaggaatctctgcatattctggatcatccaatgcccatactagttttaaatgtttaaactctggacgagtaatcatatattcatagatagcacgaggactatcattgtatttgcgagtaagaccactgaatagcaccatatctttgtctatagatataaactttccacaaacacgcagaacaaaactaactacaatattaaatatcctattaacaatataattgtgtttaagtaaatagtccaatctagctctaaattcattcatatttagttactttatttatagcttttttaatatatcaatgagtatatcattatcatttgagttacgtatggcaatacgaatcatattcttgcctttcagtcctacctttgtatcacagttcttaatgagtatattatacttgctaagcaatatttcagtcaattcaagagaagagaatctctttgaatcgacttcacacatcacaaaattagcctgactaggtattacacgtaaataagaaatttctttcaaacgttcaataaatcgaaagcgttcaacaacaagcttatcgcaagcactcttatagtcttcatcatacttattgaatatttgcatatagaattccgcaaacgaattgatattccagatggaaatatctttttttatagagttaataaattttacattgctagatgctaatactccaagacgaagtcctggtactccataactttttgagatactcttaacaactacaagattataatattgctcaagaatatcattatgcaacaaactattacttttccaattttcgctaaaatccacaaaactctcatctagtatcaaagtaatacattttctcttacaccatttcaaaaaaaacaatatttcatcaacttctataaagttacctgatggattatccggatttattaataatatcgaattaatatttttatcatcataaaataacatcaagtcttgtatagtataccttaagtctttatttttaggcagaaacgaaacaatattctccatatttttacgatgagggtattcctcaaaagttggatatatcataccagtcttacctgtttcacgttccatcaaactttttattagctctgccgctccattaccaaccacgacataatcctgtttgatattaaaatacctaccagcaagcaagctattcacaaacatacctgaaggatattcagtaagcaagcgagaaaaatttgcttgcagctcatccaacattttttgaggaggaaaatatggattaactagataacaaaagtcaagcatattttcaaatcgccaatagccaccataccgtttcatatatttactcaatttatccttctcatctgcaaagatagtttccgcaatatctttatcctgcacatcatctatctcataccaaggtaaatcaccgataggttttgctttcaattcttcaatatttataagagttatcacacgcaatacttgctcataatactcattatctcctagagctttaacataggcctctaggaaaggaatatagcgttttttgcaaaattctttcgagaacttataaatattaaccgttttataatatgagcctatatcttcgtatctaaaagcactttttggtacaaagtttacaatattattatcttgatcaaggcacaccattgtcccatccatccaggcttcatatttagcaactaatgcaagatttggatactcatcatctattagtaaatcaaacatcctatcatccacaataagatctgactccagcaataatgtgtcatcctccatcatttgttcctttgcaagagaaagagaataaatattattagttttgtcatatataggattgtttataaattctattttcaacttattatcataacgactaccaatataatctattacattttcactcttatatccaacaactataatcactcttgaaagattcatgcatgatagtttttttaggaatctatcaataagcttaattccattaatagaaatcatacattttgtgttgtcttttgtatattctcctagtctatgccccatacctgcggctaatataattgcttgcatatcgtttgttttttatattacctacttatgaatattattttttagaatttgtttttctctactatatcttcacaggctttgactagaataggcagattgactttctttgaaaaaactcgcattgaatattcaaagccacattttcccatttcaagaagttgatcccttgataacatagttgcttttttcatacatcgagccacatctttcgcatcttccggtattgctacccagccagcttttgcatctttaatacatacagcagtatcgctgtctttatcaacacttgatagtatcggttttgcagaaaacatataagcaggcaacttacttggtattgaaaacatagcagaacctcttttcatgggtaaacacattacatcagccttatcttggattataggaaccatacccgcaggaacatcccagaactcaatattacaatttgcatattctcttgctttctcttgcagactttttttagcagatccactaccagccacaaccaacctaacattaggtagttttgcaatttttagcgcatcaaataatacttctatgccagccaaaggaccaacattaccaaggtacataaaagtaaacaagttactgtcagacgtagaacatggacacctgttttgtgaatattcaataaaagagtcttcattttgccaattacgaacaactataaatttatcccttgcgatattcctagtagtagacaaatattcaaccattttttcagatatagtatgaatgcgggcagcatgaaaaagcgtatatttgtctatagggctcaaaatagatttcaatacccactttagaaaagtgatatcagggaactttgagaataacgattctggataaatatcttgtataggagtgatatatggaatcttatatttcacacaagttcttgccactatatttaagccaataaggtgccagctatcgttaaaaacaaaatcaatttcatcgtgatgctccttaatatacgttgaagatactttccccatactataactctcacaaaaacgacctaccaaggaagaagccgcacaagtgtatgaatctatctctatcacattaaatgggaaatgagaataatcacattctgacatatcaaagcccatcggacgggtaggatgaggccttaacactgtcactttatatttctcacctaattttgttgctaattgggttaatagattcgcagaaacgataggttctggataaaataccccagccactatcaatatgcttttcttattcattattatttttgatttcacgtttcattaagaactgcgctagaagaccacctattactcttcagagctccccttcttgaaacactaagcttctttaacacacgcataattatatgtttattgcccctttagagtattaaaacgttccagcctagaataataacgaagcaatttttgttcatcaagccttctgtatatcagaaaataaatcaagtcaggaaggtatcccttgatcacatctttaatataataaaagctcttccgcacacgagacaccttaaaatcagtttcagccaccggggttctccaatccttaccgtaacggaataacatcatttcctcccaatctctagcaatataaaaagcttttcctaaaaaaggtatctcagtccaattctctatatacttttggggcataggatccccacaacaggacattatattttcagctcttgaatcaggataataaatataaaaatctatatattcattttttcgaatgatagaaaggagacctctcctatcccatctagcaacctcaaaaccattctctctcaattcaaaaagcaaggacagcagtaagtctttttgagaataatgtacccacagatcaatatcctcatcatgctcaataaaatcatgttcacgaaccgctcctaatgctgttccaaaagctaaggcaaaacataatccagatttatccgcaatagatttcaacaatagtagattctctttagcttgttttttattaattttctttactcctaaatataagggacgaatcttataatcaaagtgcgtcccatctggtaatattataattggcattaatatctatttaatataattattatttttattattccatcaaacaccttttttgatatcgattacctcacctgttaatgatgagaacaatacatttatagatgtcatagccaccattttaggatcaagtaatgtagcctctggctctaccccaaaattctttatacgcattggagtctttgttcgttctggattgatacaattaatacgtataccttgatcataccattcttcactaagtgcttgcgtaaaattcacaatcgctgctttcgatgaagaataaagactatatagagaacgacctcgggtgtacgaactagaggtaaacaataacaaagttcccttggtttgtttcaaataaaaatatgattctttagcaataattatagcccctatataatttatataaatgctcttatatatctcctcataatccatatttgatagtggaaccttgtctaataaaccagctgtattaataacggcatctatacggccttctttttcagagatttctttcagcacttttgctacgtcctcttgcttcgacacatcaattccatttaacgaacgactgaacgaataaacatgcgcaccatattgttcacagatttctacgatatcttttccaattccataacttcctccaaatactacgacaatcgaagaaggaagtaatctttttgagattttagtaattcctgtattttgtaaagagactgatcgaagctgaaataatttatccaataaaaacagatcctccttataagtcagcttcatattaaacaactcgccttcaacgatatacacaaatttatctggtaaatacttataaactacaccacaatcatctgtcgttttgaattccggatcttgcaaagctaattcatatgcacgtttaattacacttaatttaaaagcttgaggcgtttgcccattacgtaaaaagtgacgaggaggaatccctataatacgattctcatcatcagcctgtatgattgtatcggttgtttttatcgccacatctacagcatcataaatatccaatgctgatatgcaatctgaaataatccgatcattaactaatggtcgtactgcatcgtgaaaaataagattaacctcctctcctgtatcataagcatttatcgccgcaagactagaatgacaacgttccttacctccttgaagaatttttttcaatttagaatatctattctttataaatatattttcaacctcttggatatagtaaggattagaaacaaccgcaatctcatctatcagaggatgattttgaaaaacatcaagtgtgtgttctattactttttttcctgctaccttcaagaattgcttaggaataggttctcccaaacgttgaccgattccacctgctaaaatgattgcaatgtttttcatatttatgaaattgtatttttaaaattaattgaaaaagtcaaaaatatcaacagataaagcttcaaatatatcagacctaatttttaatccccatcaggaactgtattctcctgctacaatttaataacagatgatgaatctcaatattttaaacaagaatcttcgtgccattgtcggatgtacaaagatacatgagggagaagtctgaaaagcttcccgcacaatccgttcgcttttgaattcctttactatacgccaaagatggagaggagattgattataagtataatctctatgaagcgtgatgagcgattgtattttcacagtattgttgaaacgggaacagatgtctggatctgatagcaaagaatttgtagacaaaaaatcatacaagtacttcaagtaattgattattttgccaggatttatataagaaagagtcgatcctgtattccctatctctagtacgtgatggtacaaagacttacaaacttgttcggcacggcgactgcggtaagcgtattccatcaagaacaataagtcctccgcagtcagttttttggtatccacaaaatgcaggttaaattcttctatcacagatcgcttgaacaatttgcaccaaatagctccagaagacggaaagtctttcagttcgtcattttccgaagaaatacccaccgtacctttcaaaatagcaaacggaagcaattctgaaggtaaaaaaggataattctccatatacgttttcccagacttgcgaatgatagttgcgggactacagaccaaatcaagttcttcgctatgggctttccgataaagtatctcgtacatattcggagcggcatagtcgtcatggtcacagaaagccacatattctccttttgccactttcagtccttcattacgagagtttccgatatgaaggttctccgaattacgaagaatacggaaacgggaatcacgctgggcaaattcttctgccaccttgtcactgccatccgtaggacagtctagcacaagtataatttccatctccttcaacgtttgggaggacagactacccaaacactttttcaagtgaacgcccgcattgtaaacgggtacgatgacacttactttaattatagaactgttatccattatgaattattcttgtttacggtataatatcccatgaatacaacatataatagagattagccactccaatcaaacagaccgcaaaaatacctaccgcacggggcttgacgcaatagaccagcatcggtatcaatacaatcgaaacgaccatgaacatttcggaaccacgattccccaactccggtacgatggaactgaatatgaatctcacggcaaaacccaccatgtatattttcagcaacaggcaataatacttgttgtactgtcgcaaccgaccggaaaagaggatgaacaaccctagctgcaagtaactgaatatcgccatattggatgaaaatacgacaacgtcaatccccttggctccattatcaccatagccaagcagtttatcttgcagcatctcaatcggaacatggttcaaaaaaaatttcaataactccgtttccagcagttgaccaaacagacatatgaaaaggcctccgcctatccaatagctccaacgaatctttccactatccaacagatatagaggtaagtaaagtaacgcagacacatgaaaagacgcagcggcggcaatcgaaataagaaaaggtaacagtttcctgtcataaatatatcggaaagagactaagcctatccccgatgccacacctgcccgtatttgagttagttcgtgcagtgagtaaaaataagatacataaatggctagcgagaatgccgtaagcttggtaaggttgcgtatacccaagtacttgaagcctacacctagcaaagcatatgtcacgaatacgggtagataatcgttggggtcaatcaacctaaatatcccacagatgatctggaacgagatatctgtctcttcagtaccatgcaggaagtagctcacatagttttcataatcgcgataaccatgtagcccatctctaaatccagccgccacgacaagcatgaccacgaataagcccatgaccgccgtatctgccttatgtagaatattacatttgagctgtaagcatccgtagatgaagcagacaaggaagatgatgagaatgaaaagggtcataaattcctatttatcaaaaatactcaatttagggcaggcctctttgaaaaagcactttaaagtgctctaaatggagttgtattaaaaattaattctgtttttaacattagccattacctaatgaaatctttgtagagattaaaattcaaataattccaattatagtttttcaaaacgcacaatgtattttatagcaacaaacaggaaacttccagacgcaaagcttgcaaccaacagcgatgcgaactgattttctatgaaagaaaaactcattagacatattaaagcacatggcaatgacacccctatccctttccatatactattaaatgggattcgtactactttatagtgcacaacataaacaatataagtaacggtcaccacaatttctgagcacaacaagactacggccgtccctacgctatgtatatgtgggacaagtaataagttgagtaaaagtcctacacaagctccgatgatagatgccgccaacaaaattttatcacacttcatcggtgtaagtatctgaacggccaatacctgtgccattcctacaaacaaggcagcgggcataatgatgcgcataggcaagacagcgccttcatagccttctccagagaggacatataccagttgtggagccaaaatgatactacaaacgatcataggaatgcaaaatatacacatcgtgtaaaatgatttattcgccaaccgttgaaaagactccttctctccgttggaaagtaatgcactcatacgaggtaacatcacatttgtaaacgctgagaaaaaaccaagtattacggaatacaatttgaaagccgtagtataatagcccacttccacattgtttgatacaaacccgaggaacataacgttaaaggtgagatacatagaagtcattatggaatatacacctaacatcaagttcttcttataaaacctctcggacaacagttcctggcatttaacactaacgaaacgacgtacataagccatattcaccaaggcatttatcactaccacggccatcgtcatgataaaataaagctcataatcgtctcttgatcggatacacacaaataccgctaccacataaaggttcttgattgcgatactgcgcaatgtaatataacgaaaatgttcaatccccgtgaaaaaccattctaccagaaacactgtaaaaataattttggaagttccaatgtaaaaaagttcctcatattgcctcaattggggaatcgccatgacacacacaagatagacaaccaaagttattaaggagaaacacaggttcatccccagtaaattggaaaatacttggttccgctcgtccaagttgcttttcaccgtagcgatctccctaacacctagtatattgattccaagtgtagcgaacaacaagaaataacttactgtattatccacaaaattcaccagtccaatacgttctactcccaacactcgggatacataggggaacgtgacgaaattcatcaaataagaggacaaggttaatatgctcttgtatgcgaaatttttctttattgaagtatctgtattcaaatcagtatatatctatttgttccaataaaaacaccttataacataaagcacttctttattagagcaagttacttgcaacatctatactaacctattttgtataattccatcatccaaccctgtataaggacttcatccaatattgcataagatggttatacaaggctggatgaagggatcatacagcgagccaatccatttatgaagtgagaaggccgccgtgcccctttctttaaatctcgtccggactctcgctatcgctaccgccatcagcagggcgaccaccgacgcttacgccacgggacgttttcaagagacggtttgatgtggaatactgtgtcgtcaccgtcagcgtgtactcaccctccgctaggtcagccaacaggagcagcgtaagcgaggaaggattattgatcgcaatcaggtcatccgtcagtttcgtgacggcatctgactcgttggtcagcgtgacacctaccgactcgtcatcgcctaccaccttcagcattgcgccacacacgaagaagttacggcccgccgtggcgctgccatccttcaagcctgtcttcttatccttggtctcgaggatgtacatgatgttcaatttctcaccgaggatctccaccgcagtcttggcgatctcctcgcatagtaccttaccttgcgtcaaagagacgtagatcgagttcctctccttgttccatacgccgccctcgatcacgcccttcagctgcggaacggaacagacccgtgttcacgctgtaaccgctcaagaccaaatccatcacgattcagtggtagagtgtcaccgagtgacgcaatatctccggacaaagccccgtgtcctgcttgtacatctcctccaatacgtcatccagatccaagcttcctgcagaatccagcaataggatcttgtccgtcttgttgtcggtggtcaccgaattgtcgatgagccagcctttcaatactttcttcatggtattcttgatttaaaggaggagtggaattgctcccccggattattacttataccttagaatttcttcccgaacgctatgttcaagaacgtcttcaccaatatcttgaaatcgaaccaccacgagcggtgctccagatagaacaggtcgtagcgcaagcgacgaagcatcttctccaacgtgtccgtatagccgttatagagcgtggcgtaagaggtcacacccggacggatctggtacaggtaacgatagcggggatcacgttccatgatctggtcgatgtagaactttcgttccggacgggggccgataaaagacatatcaccgatgaaaacattccacaattggggcaactcatccaaatgatgctcacgcaggaacttgcccacacgggtcatgcgggggtcagtacctcccttgtaaagagccggaccgaatttctcagcgtccaaacgcatgctacggaacttatagatgttgaacgggcgaccgaaacgaccgatacgctcctgcttgaaaatggcaggaccgccatcctcgcgccttacggcgatgtaacagatcaagaacaaaggggagaatacgaccaaggcgataaaggccaaaaggcaatcccctatacgcttcacgttacgctcgaaggcgttcatcccatctgagataaaatcagtagattttccaaaactctcttctaaaatcatggctagttaattagtcgatgaaggcaggcacgaggttaaaacttaatctcatttgcatagcccatccttaaattatttctttcctccgttcatttcctcctctttcttataatcgatataccgttccaaggcctcacgtgccagacgacggaaaagttcctcgtccgacagatggtcccaaaggagatctaccaatcgatagtaaacgctaaaatgcatgtccttgcctttttaaaagaattgtaagtgtcactgcccagacctccgcttatgcggataatggactttgtcagtctggtgacttgtaaaaccgtggcgatgtaatcgcccaaacggggaaatgattgtttgtgatacatgtctggtttgttattatttttatacagtccttatggagaccccaagtaatgcaaataatgcaagtaatgcagcacctttttcccacacacgtgcgtacattatataaaacaagaattttacactaaacgatcacaaacaaggcatggaacgatccggatgagaaacgctggatagccgtatgaaagtttgattcgacatatataatgtacacgtgcgtgtgtgggaaaaaggtgctgcattacttgcattacttgcacctgttttccccggcatcggttccatcccgcacgtatatcggcatcgactcacgcctacgttcgtataggcctacaccgatatacgtgtggggcaacgtcgatatacgtgtaaaacgatgcccttatacgtatgccacactcatacggtctcgcttagcaatggcaatccctccacctctctcttatgccagccttggtaatcagacagggaaaaaccggggacggtcaattgcttgtaatccttatcgtctcttcgcaagatgtgcttgcgggcatacgagcggagcgaacgatccgtcacggataccatcaccacaggaaacgggtagccgagcaagcgcatcggcgtaacctcgctgtccgggaacgcacggcgcaactgataggctgagtactcgaacgccacccagtaaggacccgtgcaatacaaatggatggaagcagtgttcgttcgctcgcggctcatgatatcacccaaatgctcgttcagcaacgccaccaaacgaacgccagaaggaagggaagacatttctttttgatttatgatttttgatttaaactgtcaactgtcacttgtcaactgtcaactcatttcgtgtttcagccagcgatcgcaatcgtccagccggcggatcaaggataacttgcttttcttgggcgaggactcaccccgccaaggatccaccacctcatgcgccatctgccggtaaagggcgctgtccgtgcaaccgtagagcgtcaccagcaacaaagcacgggattgcggagctttcaccaccgggagcataccacgcatcgtatcatgcaaacgtgtgaactcctcctcatcgcccaacaacttgtaagcagaaagaagcaatgagtagatcttgcaacgcatcacgtccgtctccgcacggagcgaaccgtacgatctcaacacctcacgggccaaacgagtatcctcctctgatacgctgccggaggcatggtaacgtcccaaggcatcgtgcaagccctcccgcaggcgatcgttgtccagatgggtatagacgtgcttgcccttggtgttcagctcgatcagctcatactcgcccggcttcacctccaacaaggggacccacatgcaatcgaggatacgtgccatcacatctttatgcccgccacccggctggatcaccacctccgcctccataccggtaaaataaccggacgtgatacgcacgcgatcaccttttagcaggcgattgctgtccggcacatacaccggaagctcgttggaataagattccgccacccaacgtaaattacccatctcgtcatccgagagataagggaaatgagtcatgcctccggaagagacccggggaaggaaattgtataggggaagcgtgcgcttcatctggaagatttcctcaaccgaggaccggacaaacacgtagttgaacagcaggggccgcttcgtgttgaccatcttgccgtccactttcctcacctccacataggagggggcgaaatactcgaacaacgtctccccacgacgcttgcgccgggaaagctcggcatccaagcttttagcggggctgatcttgtcgcgtcgtgccacacccgtagtaggaagcgtgagcacgtaccagcgtacagtcttcaagtcatgacgcttgccaacttgcgccgtaccccgctccgagcaaccgtctcttaaaacattcatcattatggttatcttttcctaagattatatcaagatctccactcaagcctcacgacaattcaaagccctaccaagagcaccctatttactcctgataaacaacactttatgtttttaaaaatggcttttctgaaaatcaccatcggttgaaatattaagctactcgggaagtagcttaaaaggttggaaaatggttattacccagttgtagagacggggcatgccccgtctcccacagactggtagtatctttaaattaccctcttgaggggatgagacggggcacgccccgtctctacaagaatgtatgttcgatttttaggagggacgtgatgatgtaggaaatacgagatcatttcgtctctattgccatgtctagtacagatcaagacgtggaatatacaaatcacgacgtggtctatatattccacggcgataatctggaaatagatgagatagtaattatatttgtatatagtaagaagaatgttttttacttgaagatacgaacaattgttttgattacaatcgttgactatcctttagatttaagggcaggacacaaaaaaagggaaacagttgaataccaaccatttccctttttctaagtcggggtaccaagattcgaacttgggaccccctgctcccaaagcaggtgcgctaaccggactgcgctacaccccgttttgcaattcatagtgtttatctctgattgcggtgcaaaggtacgcctttattttaaactacaaaactttttggtaacttttttcatgaaaaatatcattttcttgttgagtggatagaatggaactttgcgtcagatagttcttatcgttggcgtaaataaataaaagggttccattctttatcgtattaataattggcttactgacagatacaggcaacgcagggcaaccaaagctacgtcctaaccgacccgaggaagctgccacagaaggatcggaataagaggcgccatgaattacaatcgccctttgcttagccaaatcatttattcctttttccaatccatttaggataagcgaatagccattccggccttggtacgtattttccgtcagataaaatcctaaagagcttttatgggaaccgttctcgttcgagaaagaggtcgcataattccctccgctattcttaccgtgagaaaccaaagaggtgtaaagtattctcttttgccgtatatccaatacaaccatacgctccgccgtagaaggtttagagaaatcgatcaatgtaaggatatccttatttttccgatcaatcttctcggaacctctaagcccctgcataaacgcatcgaaacaaacccattgatccaatcgcatctcctcatataattggcgccccataaccgccacagacgttgatcccgtttccggagatagggcacgcaaaacgccaccggttgaaattgaacctacagacaagacaataaaaaacaaatacaagaaaatccttcgcatactcaaaaacaataacgccgcaaagttatgatttttattctaatacaaaaacaatcgtcttattaacaggcgcccaatcgtaaacaaattgcgcatgcgaagtcgcgtttctcacacacatatgagaccgtggtgtcgttcccaacgaaggactatattcgatcaacgatttacgaggagcgttgaccggtacgccatggatatacgccccattcgtaaaacggttggcataaggagcgaatccgccagtctccttggaaccgtctaccaaatagatcatgcgagactttttttcttggagaacatacattcccaacggggtttcctgcgcataaggaggacgatgctgtccggtagtcgcagggttcatgctacgaaccaaccattttgagccgacgtgctccaaggtcgcgatattctggttatgacgatccacgaagatcgccttatcgaagactaccgtatcccctatttgcttgatatatttcttcggagcataccactcctcctccccatcatacacggtttgtatacgagcgaatttagaatcctcatccatcgccttgatacgaaccaagctaccgtcacgtccatagatctcgggaatcacggtatcagtcagcaaataaagcgggacggattgatagcgttctacaccaagcgtatcggaaaccctcttataggcatctctcttgaagacttttacaagaggagcctctccattcctgtttttatagttctgcaagatcgcccattgagacggctccttttggatcgactccaataaggataatctttctttcattttctcccactggaactcccgtgtcgtatctttataggggtaagtatcttctaaagtatgcttatcgtaaagcagctctttctctatttcgatacggggaggcaaagtctccacgatcacagcggaatccttcgatatagaatccacaggagttaagacctcggtttgagcaggctcggtcctcggcgtacaataacttagcgtacaaaggctcgatatcaaaagtataaaaactgttctcgtcatcattattacccgggatttatttgaatatcgtaaatatacgattttttccaaataacaggtaatcttatcatcttgtttacaaagtaaccgcgccaaatgacagagctatcctatattcatcctataatccatttactgcccggtattaatgagataatctttgtcgtcacataacagcagataaatgtacttaccgcaatacatggtatggcggcgacagtaggcaaggctaagtcgtgcttaaacaccgttacccacaatccgagccaaaatatatgcataaggtacataccgtagctgagtttagacatctctgttatgagtcgtggagatttcgaattgcctatgcaagtaaaagcgaggaacgtacccgccgtaagaagcacacagttgatcgtacagaaagcccatccgatctctatctcaggtgtgacaagagttactccgggtatcgcttggacatagaaggaataaatcgtcagcaaggcaccgacgaccatcgaggcgattccgataaccagacgtttagaacggttccatgtaagatggacatgtatataatgtgccagtacgaggtatcctaaataaccggagaagtaccacagtatatggtattcgttccaaaaacattgtccccacacctcgccgaagcaacgattgagatagggcatacaggtcgacaacagaaacaagccgatgaaaaaacgctcttctttcgccgtggctttattcaaccatggcgatattacgggtataaataaatagaggctgatcaaagggtacatgaaccacaaatgtccagcctgtgaaggaaagttcaagaatattctcgatatatctttcaatgatgtctcggcatctatctgcccccacagcaagggtaaagtgctgtatagtatcataaatatgaaaaacggcggtaagatgcggatacaacgctgacggtagaattgccaagaggtcagccctgccttcatcggcgcaagaagaaaggcggagacaattataaacaatggcaccgccatgcgtgagaaaccatcgtatacggctacccacaaccgatcggcctcattggccagataagattgcggtcccaccatatccgtggagccctcagctccataaaagttttcactggcgtggacaaccatgacaaggaagcacgcaaacacacgcacgtaatccaaaaaaactatacgcttcattttttgttttagtattattattcgttagatgatttcaagtttgtctttttacgcgaagcatgcattcaagagggatatatttcgatgtttttcctgatactgctttatggcgcacaaaggtaaaaaagtcggaaagaatatatacctttgtcatattataagtgaaatctaaaataaaaacatatgagatctattaatggcgcggttttacgtagcgcattcgcgatggtattagggtttgttttggtattatggccggaagcagccataacctatctggttatcacgatcggtatactattcattttaccgggattattcgctatcctcagctatttcacccgaccgaagaacgagaacggggagaaaccgatgtttcctatcgaggcagcgggaagcgtactgttcggagcgtggttggtgatcatgcccgagttcttcgtgaatatattaatgtacgtactcggagccttattggtaattgccggtgtacagcaattggtttcattgatatccgcaaggaaatggagcaatgtaccgttggggttctacctgatgccggctttgatcttgataaccggagtaatgattcttgcctacccgttcggggcggcggcaaatacattcgtaatcttcggtgtagccagcattttctacggggcttgtgagttgatcaactggtataagttccgcaagcgtatagaaaataccggattatgatttccggtattccatgggtgatatacccatatgcttcttgaaaaacttaccgaaagtggattgatcggagaagtggagtatatccgctacttgctgaaccgtggcttgcggggccttcaacagcatcttggcctcgacgatcaaggcgtcgtcaatccatttattcgctgatttacccgttagctctttcaagataagcgaaagatactgtggggtaataaataatttctcggcatagaaagtaacgacgtgctgctccttgcaatgctcgaaaagcaattgcaggaactgctcgaaaagctcctccttccgggagagtgtaggtgccgtcatcagctccttcttacccataaagatattagccaactcgataaagaaaccgactaaggcgttttggagagcctccttctggaaaaaatgggtacgcagcttcatcttttcccgtaagattgagaattggccggatatatgctcagtctcctcggcactcatcgcagcacatggattcttacggatctgcatataatgcaccatagagttttttttccctgccggggtagtatatccatccagaaaaaatctggacacgatcaacaaacgccctctcaaatctttgctcactttcgatacctgtatgatatgagtcggcatcaaggttataaacgtattcttctctatcttatatggaatatagtctaccgaaatatcagcagtaccttcctgtaccaagatcatcaacaaggcatttaaacgcatcggggtggaatgctccagccttttttcctcgtaattaatcaaatctccattcagatccgctatcgataaatcatcttgaaagttgtcgctggactcaattcccttgattaactcagtgatttcaattaaaggtaaatttttcatatctatctgtagatttttattatcacctcggacaaagatagaaataaaaagccaaagaccacccactatttcgtttttaaccaattttcatccaaaattgaacgaataacaagaatttttgacaatatcctgtttcattccataccaataccgtaacagtataaacctttctggttttctaaatatatcagacctttgcgaatagattcgacgggaatatccggtcattggtcgattccaacggacgagtcagcgctttttacttgtatacggggattgccccggctacttttgacgtaacaaaaacgaatatgataaaagaacagattattaatacggcgttcgatcttttttctcaatatggcatcaagagtgtgagtatggatgatgtagcgaaagcggctggtatctccaagcgcacactttacgagtcgttcgaggacaaggaaaccttgctgatcgaggggatcgatcacaattccgaatcgctcggacaatatctgacgggactggaaaaagaacctttcaatgccttggaagtaatcctgcttttctatgaggagatgatgaaaaacccgagatggttcaacgagaagttttacgaggacttgaagaaatatccgaaagcccaacaaaaaatagagatgaataaagcgagaatgggtaagaggtgtatggacttgttcacacggggcgttaaagagggcgtgttccaagaggggatcaacttcgagatcatggccttactggtgaaagagcagacgaagatgttgcggccttccaatgtcttctgcaagcattccatcaccgaggtatacaacacgatcctcctcacattcctgaaagggatcagtaccgagaagggaagagcgatcctagaccgattcgatctcaaacaatcctatgatttatagcgaacacttaatgagtttaatcacagacaaaatctatcctaaatgaaacgattattgatgagtagaaaaatgatgttggtcacatttatggtattgccttttctggcggcgagaccggttctggctcaagacaccctgaaactggatcttgggaaagcgctagagatcgcccttagcgagaacccgaccgtaaaagttgccgataaagaaatacagaagaaaaagtacgcacgtaaaggctcgtacgcttctctatttccgcagatcagttttgcgggggactacaaccgtaccttgaagaaacaggtgatgtatatggatttcgacatgggtgacatgggaggcggcagcttgcccgaaggcacggacatgtcgagtatggacgagggtttcgaggtaggacgtagcaacaactggagcttgggcttcaacgcttccatgccactggtgaacgcctccttatggaaaagcttgagtatctcggccttagacgtggaattggcggtggagcaagctcgctcttctaaaatagcgatggtgaaccaagtgaaaaagagcttttacgccgtccttctggcaagcgactcttaccgggtattcaagcaaagttacgacaatgccatggagaattatctggatatcaaacggaagtatgaacagggaaccgtagctgaatacgacttgatacgtgccgatgtgacggtaaagaatacagagcctaatctgttgcaggcagagaactcccttaccttggctaaatggcagttaaaagcgttattgggtatggatctggatttaaatatcgattgcgacgggcaactgacggatttcaagtccagcctcttcgccgactatctatccacggatacaaccttatccgagaatacggacttgaaacaattagaccttcaggcggaacagctaaaaaagacgctggtcatgcagaaattcgattatctgccgaccttgtcgctgaccggtctatatcaatggagtgccatgaacaatgacttcaagttcaagaattacagatggaacccctattcgatgatcggtatcacgttatcggttcctatcttctccggaggtagtaaattttataaggtaaagcagacgaaagtctccatcgaccaactaaacctgcaacgggacgataccaagcgtaatttgcagttggccgttaaacagtacatagataatatgaatacctgtatcaagaagttcgacgccgcccaaaagggagtcgagcaagcggaacggggatatatgatctcgcaaaaacggtacgacaccggagccggtacatggctggagatgaacgatgccgaacttgccttgacgcaggcccggttgaacttcaaccaatctatctacgactatatggtagcgaaggcggatctggagaaagtattgggtaacggacagatgaattgaaaattaaaaattgaaagtttaatagataataattaggaacaattatatgaagacaagtcaaatgctgaaagtaataccgatagctacattggccctgctgatgtcttgctcgggtaataagagtgaggaagccacggaaacacagaatgagaaagtaaaggtgaaagtggagacggtctctgttcaagacgtggagcaactcagtgaatttaccgctacagtggaagcgaatatcaaaaataatatcgctccccaaaccccattccgtatcgagaaaatcttcgccgaggtaggcgaccatgtaaaagccgggcagttattggccaagatggacgctacaagtctaaagcaagcgaagatacaattggataaccaagagatcgagttcaaacgtatcgacgagttgtataaggtaggcggtgcttccaaatccgcttgggatgcccaaaagacttccttggaggtggctcgcgagacgtataaaaacttggtggagaacacccaattgctaagcccgatcagcggagtcgtaaccgcccgtaactacgatagcggcgatatgtacagcggcggaaaccccatctatacggtagaggaaatccgtccggtcaaattaatggtgaatgtctccgagagtctttttacgaaagtgaagaaaggccatgaggtagacatccggctggatgtctacggagacgaggttttcaagggtaaagtcaacttagtttacccgacgatcgatcccgctacccgcacgttccccgtggagatcaagatcgccaactcggatgagcgagtgcgaccgggtatgttcgcccgggtgacaatgagtttcggccatatggatcacgtggtggctccggatcgctctatcgtaaaacaatcaggcgccggcgaccggtatatctatgtatgcaaagacggcaaggtatcctaccagaaggtggagctaggacgccgtatgggtgataaatatgagatcatatccggagtggaggatggcgaccaagtggttatcaccgggcaaagccgcctgacgaacggtatggaagttgaaatcgaaaacgaataacagactatgagtttatatggaacagcggtaagaaagcccgtatcgaccgcccttgtatttgtggcgatcgtgatcttcggacttttttccttaagcaggttatcagtggacttgcttccggagatagagacgaacaccatcatggtgatgacggcctatcccggcgccagcgcttcggatatcgagatgaatgtttcgaagcccttggaaaacgtgttgaatagcgtaagcgacttgaagcatatcacgtcgcaatcccgtgagaatatatcgatcgtaacgttggaatttaattatggcatcgatatcgatgtcgccacgaacgatgtccgcgacaaactggacatggtagagtcttccctacccgatgacgtagagaatccgatcatcttcaagttcggtacggacgatattcccatcttgatcctctccgtaaccgcggaggagagcacgaacgctctttacaagatcttggatgataaggtatccaacccattggcacgtatcagtggcgtgggcgccgtttctatctccggtacgccgatccgtgagttgcaagtgtattgcgacccgtacaagttggaggcttacggccagaccatcgaaggtatctctaccatcatcgcgcaagagaaccggaatacaccggggggtagcgtagatatcggctcaaatacctactccttgcgtgttcaaggagaattcacggacgctaagcagatgctggacctagtgatcggtagccagaacggaaagaacatatatctgcgtgacgtggcccgtgtagaggacagtatcgaggaacgtgcgcaagagacgttcaacaacggcacgaaaggtggtatgatcgtcatacagaaacagtccggagcgaactcggtgaacatcgccaagaaggtacaccagaaacttccggagatacaggctagcttaccctcagacgtgaagctggacgtaatcatggatacttccacgaatatcttgaatacgatcgatagcttgaaagagacgatcatgattacctttatcatcgttatgttggtggtattcgtgtttttgggacgttggagggccacgtttatcattatcttgaccatcccgatctccttgatcgcttctttcgcttatttgctggcctcgggtaatacgttaaacattatctcgttgagctcactttctatcgctatcggcatggtggtggacgacgctatcgtggtattggagaacgtaacgacccatatcgagcggggtagccagccgaaacaggccgccgtacacgccacgaacgaggtagctatctcggttatcgcctccacccttacgatgttggcggtgttcttgccgttgacgatggttacgggtatggcgggtatcttatttaagcagttgggatggatcgttagtatcatcatgatcgtttctacggtaggtgccttgacattgaccccgatgctttgctcacagttattacgccagcaaccggagaagggtaaattgtaccggatgttcttcacgcctatcgaaaagggattgaacgccttggatcgcggttacggacgcttcttgaactgggccgtacgccaccggaaaacggtgatcgtaggcgctacgctgatcttcatcggcagtatgatgctgataccggtcatcaagacggaatttttcccgacgcaagataacgcacgcatcggtataacgattgagttgccgatcggtacacggcaggatattacccgtgagttagctctcgacatcgacaagaagttccgtgagaaatatccggagatcctgatcagtaacttcacggaaggtacggcggatacggataataccttcgcccagctaagcaataacggtacgcatatcatcgagttcaatataaacctgactagcgtgggcgaccgtgagagaggtcttaccgagatttgcgagttgatgcggcaggacttagcccaatacagcgagatcaagaaattcgaggtactcgccggagggcaggaaggttctatgggtggagagacctcggttaacatcgagatctatggttttgatttcgcccagacggatgccgtggcgaatgagatcgcccgtcgtatgagaaatgtaaaaggatgctcgcaagtaaatatcagccgtgaggattatatcccggaataccagatcgacttcgaccgggagaaactggccatcaacgggctgaacgtaaccaccgcctccatgtatctccgaaaccgtgtaaatggttccaccgcttcaaaatatcgtgaggatggagatgagtatgatatcaaggtacgttacgccccagagttccgtgagtccgtagaggatcttgagaatattttgatctataacaatgagggcaaaggcatccgcatccgtgatttaggcaaggtagtggaacgtatgactcccccgaccatcgagcgtaaagaccgtgagcgtgtgatcaccgtatctgccgtagcgggtaagggagcagcattgagcgacttggttgccgccgcccggaatgagttgaaacaaatggatatcccatccgacgtaagttggcagttgggtggaacattcgaagatcagcaggatacatttaccgatttgggtatcttgatggtattgatcatcatcttggtattcatcgtgatggctgcccagttcgagtcgttggtagacccgttcgtgatcatgttctctatcccgttcgcctttacaggtatcgtattgggattggcggtcacgcagacaccattgggcgttatggctttgatcggcgtgatcatgttgatgggtatcgtggttaagaacggtatcgtgctgatcgactatacgatcttatgccgggagcgtggcatgggtattatcacgtcggtagtgactgccggtaaatcccgtctccgtccggtattgatgacaacgttgacgaccgttttgggtatgatcccgatggcggtgggaaccggcgaaggttccgagatgtggcgctcgatgggtatgactgtggcttggggtctttccgtatccaccttgattaccttgattattgttccgacggtctatgccgtattcgctgccaacggcgtaaaacgaagacgccgcaaaataaggaaggcattacgaaataattaattatctttgcgtaccatagggaagccgaggccaagcaaacctcgatgggcattgttaggtcataacaatgcccattgtaaggtgcttacgatgcccattataagcaggcttgaatgcccatcgtaagaaaagcttccctacggatatgcgatctcataaaaaacaactatatgaaagcgatatttatatctttcaatcaagcgtattacgaagctatcgtcagtatcatggaccgtaataaccttaaaggttttacctattgggatgtcgtgcaaggacggggaagtaaaacaggcgagccacattacggcaatcacgcttggcctaccttgaattcagctatccttacgatggtagaagaagagaaggtcgatcattttctggaaatcctacacaacttagacaaggaaacggaagcgcaagggcttcgggccttcgtctggaatatagagaaaaccatctaacttaatttttcgaaacaactacattaatctattgatatggacaaatcaatcctgtttacacccggtaagatcggtccgctaacacttaggaaccgcacgatccgggccgccgcattcgagagtatgtgcccgggaaacgctccctcggagcagttattcaactatcacacatccgtagccgccggagggatcggcatgacgaacatagcttatgccgccgtaacgcaaagcggcttgtcgttcgagcgtcagctgtggatgcgtccggatattattcccggcctccgcaagctcaccgacgctatccataaagagggagccgccgcttccatccagttaggccattgtggtaatatgtcgcataagcggatttgcggatgcacgcctatttcagcgtccagcggtttcaacctctactctcccacgatcgtacgaggtatgaaacaatccgagatcgcttccatggctcgtgcctacggtgaggccgtacgattggcacgtgaggcaggtatggacgctgtcgagatccatgccgggcatggttatctgatcagccaattcctttccccgtataccaaccaccggaaagacgaatatggaggaagccttgagaaccgtatgcgcttcatgagaatgtgtatggaagaggtgatgaaagcagcaggttccgacatggccgtaaccgtaaagaccaatatgcgggacgggttcaagggaggacttgaaatagacgaatgcctagaagtagcccgtacactccaagaccaatgcggagcgcatgccttagtactaagcggcggattcgtgagccgtgcccccatgtatgtaatgcggggagaaatgccgatccgtacgatggcgtattatatgcctcgcggctatctaccgattggaatccgcatggtaggtaaatatatgattccctcggaaccgtttaaggaggcttacttccttgaagatgcgttgaaattccgcaaagccttacatttacctcttatttacgtaggaggattggtctccagagacaagatcgaggaggtactgaacgacgggttcgagtttgtggccatggcacgtgccttggtgaacgagccgggcttcgtcaaccgtatgaaagaagacgagcacgctcgttgcgattgtgggcatagcaactattgtatcgcccgtatgtatagtgaggatatggtctgtcataagaacgtgaaaggtcttccggaatgtatcgtacgtgaaatcaaaaggcttgaatataaataatggaaaagaaatgggctttagtcacgggggccagctccggaataggtctcgcctatgccgaggaactagcctcacgaggctatcagttagtgatcgtcagcaatgaggagcaggcgatccgggagaaaggtgagtttctctccgagaaatatggtatagaagttttgccgctttatcgtgatttggcgatccccggggcggccaaggagctatatgatacttgccaagagaaaaacatcccaatagaggtattggtcaataacgccggtatgttttttttctgcgagaccttacaagctaaggccaacatcgtcgagaaaatgctctacctccacgtgaccactcctacccagctttgttattatttcgggcaagagatgaagaaacggcgtcatggatatatcctcaatatgtcatccctatcttgttggctaccttatccgggaattacgctgtacgcttccaccaagcgatacttgaaaagcttctcccgaggcttgcgttcagagttactggattatggagtaagcgtaaccgtactttgtcccggcgccgtcgccacgaatttatataacctaagcgacaacttaaagaccttagcgatccgcctaggtatcatgatgcgtccggaaaaactggctaaaaaagggattaatgccttgtttcaccaccgggcttccctattaccgggcctcttcaacaaaatatgcacacccctcgtaatgctcctcccccacggccttgtccgttggatcatgcgaaccacgaaattagtgaagctagatcgataatccgacaaataacatgcgaaatatttgtcacatcaaacaaaaatcgtatctttgcaccgctttttagccccgtaccgtgtgatgggaaattaggaagcaaaataactaattttgagtaacacaaaaattaaagaaaatgaagacatttgagttagaaggaaaaggaagagagatcgtcgctcgttccgctgatcagaaaagagccttgaaggcaatgcgtaagaacaatgaaattcccgctgtattatacggtggcgaaaaagtaactcacttcacggttacaaaagaagccgttcgtaagttggtttacactccggagattttcgttgttgagttaagcattgacggtaacaagacgatggcaatcgttaaggacatgcagtttcaacctgtaactgacgaaatccttcacatggacttcttggaagtatctaaggacaaagccgtagtaatggaagttccggttgttttggaaggtcacgcagaaggtgttaaagccggtggtaagttgtctcttcaaatgagaaaactgaaagtgaaagctatatacgatcaaatccctgaaaagttgacgattaatgtggatcaccttggcttaggtaagactatgcaggtaggtgctttgcacttcgaaggtcttgaattgatgaacgctaaaaacgctgttgtttgcgccgttcaattgactcgtgccgctcgtggtgctcaggctaaaggataatctgaggtaaaaacattattacaatacatgaaggggaggatattcatagaatgttcttcccctttcttttatagattcgaggataatgaaatatttgataacaggacttggtaatatcggttccgaatattggggaacccgccataatataggtttccgggttgtcaaccatctggtagagagcgtaggaggcaatttcactgaggagcgatacggggcaatcgcacgcatacgggtgaaaaactgtgacttgatcgtgctaaagccgaatacctttatgaacctcagcggcaacgccgttcggtactggttgcaaaaagagaacattcccgtggaaaatctattgatcgtcgtagatgatctggcattgccattcggaaccttacgtctgaaaccaaagggtagcgacgccgggcataacgggttgaagaatatcgcccagttattgaatacgcaggaatattcccgccttcgtttcggcataggcagcgatttcccacggggcggacagatcgattacgtgctagggaaatttcccccggaggaattgcaattgatgccagagatattggatcgtgcgacagagatcatcaagagcttctgcctcgccggcatccagattacgatgaatcaatttaataataaataaaaagagactgagaatacagatatgaacgaggtacgtatcgataaatggatgtgggcgacccgtatctttaagacccgcacgatagccgcggaagcttgcaagaaagggcgtatcatgataggtggagtaacgatcaaaccttcccgcatgatcaaggttggcgatgtgatccaagtgcgtaaaccgccgatcaccttctcttttaaggtaatcggattgatcgagaatcgtgtgggcgcgaagctcgtcccgaattacttggagaacgtgacaaccccggatcagtatgagattctggagatgaaccgtatctccggtttcgtgaaccgtgcgaaaggtctcggacgtcctaccaagaaagaccgtcgtgaactggagcaattcactgagccggaattcatggatgacggattcgatttcgagttcgactttggagaagaggaagagtagtaagcatgctgatttccatttaattacatttaccaatattttcatcaagaagtaaaagtattttcacctagaggtaaaactgtttacatactgatgtaacgacatttacctctagaggaaaaaacatttaccattagaggtaaatggcgttacaacggtatgtaaacggcaattatccctattgattctcctcggaaagcagattcccctcctcatcccagctacgccagacaccagatttcttccctgccgtatagaacatctcatacaacaaatttcccttatcactccagatacgccaagggccgtccttttgcccttccttataagaagccaggccgatcagctggccgttctcattatatgtacgccattctccgtgaaagatcccatgataataggaacgcacctcggcgatcttgccactcggataataaatcacgtaagttccctccggacggccatctttcaaatataactccatcttaagcataccatcgtcataaaattccgtataacgacccgtatatggagtggtttgcgtggcatcggtataatactgtccttcgcttaaaaccaagtcttgcgcttgtacggtccatgaggcccccgccataaaagcagaaaataacaatagctttttattcatgatacattcttatctaaattatatgcgaaaagacaccgagggatctttccggatacctcagtgccccaaacaaattcacagcctattcaaagtcaagctaaattaatattcagtgttattcggatcgaagttggtccagttagcggcccagtcattcttgccatcaaaagctcccttataagataccttctcgaagaaagcgtcgttcaaagccgtatcagagaaatccgctccgtcaatcttatccgctacgatcgatgtatagtcaccatctttagcgatgatatcattgctggaagcgtaagtaaggttgctcaagtctgctgtctgaaagtaattttggctagtttcatccttgaaattctcccacataccggcgaagatcacattcttaacaaccgcacccacatttgcgttttgcagatacaaaccgtatggccaacccacgaaaatcgagttatacacattcaaggaagagttacggcggatgtgcatagcggcttggaatgatccacccttagcgccattagccgcgtcttccgtaacataaaagatatcattttccgttttaccagctgattcaccatagaacggaccgatcaaggtcacgttagaaaagaccggagtggtaagtggagtattattggaaccatcagcgtcgttatcagactcgaagccattggacttggacgtatcagcgtgcttcgggtcgcgaacgcctaacaagaactgcaatttaccttggaatccatagtccgtatcaaactcatcatcccaacctttgtaagcaatcaggtgttttgcgtttaccgtaccgccaaaccactcgaatgagtcgtcgccacagaaagagacctgcacgtattcgatcgtagtgccacggccaacaccaccgcaagtcaaaccattgatctccttatttggctccaatggataaccggcgaactcgatacggacatatttcacgataccggagttatcttccggatcctttccaccgtagtaagaacgaggaccgccctctatctgagcctcgccagccgtattattcacgatagacttgccacaaagaatcaagccaccccaatcaccataggtacgagaagctttcggttggtcggaagtgaacacgatcggtttctccgccgtaccctcggcgatgagctttccgccacgctcgacgatcaaggagcctttagacgatttctcccccttgattaccgttcccggctcgatcgtcaaggtcacgccatccgtcacatatacgaaacctctcaacaggttgttatcagcagccttcaaggtcatatccgaggtaatctcaccttccaatataacatcttgagtttcctctacaggcggctctacatttacgagatcatcatcgtcgccacaagcggttgttccaaacatcgtggccatacagaaagcggcggccacaccttttaataataacttgttcataagtaaacgaatttagtttatatgagtgaattcaaattaaaacttcacggctacacctagattcacggtcacacccggacgatagctacggattaattgctcaacctcccgtttctctccggaagcctctgttaactctaggaattgtttatattctacttttgagttcaatagatcttttacgcctcccttgacctccacgtatttaccgatcttcttcgagaaactcaagtccaaggagttacggggtatctcatagatatcgggaatatcatcgttcgggttctgcttcggtacgcctaccgtctcaatacgcttgccaatccggttatacaaggcggaggctgagattcctgcgttgtcattctgatagaataagcccgtattgatcaagtaaggggattgcccctgcatcgcacgatcccgctcgaaagagccctcggcgaaatacaccctactatggatataagccccgttgaatacgaagctcaagcctttcagaccgataaagtccagattcttcttgatatccagctccacgccgaaagcattcgcatgatcggcgttgtggtatgtgtactgcaatccggaacccgcttccatataggtttgctcgatcggattatcgaaccgtttgtagaaaccgccgatcgtcaccgtctcacccggagccgggtaaaattcataacgcagatccatattattcgcataagcgttcttcaagtttacgttacccgtgatattcgcatctaaggcgaaatcataatatacgtaaggtacgatctcccggaactccgccctattcacggaacgtccataagccaagcgtacttggtgcttctcattcaaattataagcgatgttgacggaaggaaagaaatccgtagcgttctgatccagatgcaccggttttataccgtccgactcataaccatctaatttcaattgatagtactccatacgtacacctacgttcgcattcagcctctctccccagttcagtttagcggctacgtaagcggcacccagcagattatcggaagtataagagtcgctcttgttcgtactctctttcatatagatacgatcggtcgatatatttgcgtccgagaagaccgagctgtagtcccattcggcaaaacggtcataaccacttcccagcatattatagacaaaacgacgggcatcaaagttacgtttcttaaactctccatatacccccgtgttcaagacaggggtaaacatctccgagacggcgaacttatgctcgtaattcaaggcggcggaagcgctgttatctttcaagtcttgataataacgagtcgggtcggacacgtaataacgagagtcaccatccgtcgtactctccaaagattttaccaccttgcgatccggttccttgtaagcggcgaaagcataacctaacgtccaatccagtttattcatatcttctctcaatttatgctccccgcttagctggccggaataggtagtgcgtccggtataaagggattcccatttccggatattttggtcggagtagaaatccgttccctctcgttgcgataaggaagaggttccacgctggttgaagaaattcctgaactcatatttgctcgttcccttcatcaacgaccagttgaacaaggctcctaattttgtcgtattcttatattgtacatcatcgtagcggtaacggtatgaggattgatccttggccatgtcgtacgagaggtagttgttgtttttcatctcgtaataatcatagcctgtgctatagttcacactggtgatattaccgatcttcatgtcaccgatatcaaaggtacgattcatcatgaacgtcagtttctgttccggcatcgccgtgaaatgacacacgttccatcctgtattcacccgcttcgtaaacgccgccgcatccgctgccgatatgtcgttcaaatgagatggggcgttcgagggtaacattcgggagccagcgccaaagcccagataatccaaggcggaacctttcgtcagttggaaatctcggaaagcggagtttgtattaaacccgacttgataggagacgttgagcgtattaccctcgggaatattctttgtcagcacccgcacgaaacctccggagaaatccgccggcaattccgccgaggggcttttatagatcatcatattatcgatcaaggaagagggcagcacgtcgaatgagaaagcacgactatccgtctcgctggaaggagtcgtggcattgttcagccatacattattataacgttgcgccagaccccggaccacgatgaaacggtcgtccacgatggtgattcccgggatacggcgtagtacctcggcggcatcgctatcctgtgttttactgatttgctgggcggagataccattcacgaccggaaggctcttgcgtacggtattttgtacggccatctcggttcccaatttccgttgggccactacgaccacattctgtaattggaggttagcgtcggaaagctcgatattcaacaccgcctcttggcgtgcgactaccggaacatcctttaccgtttgcgtttggtacgacacgtaagaggcggctaccgtataagtacctggtctcacgttctcgatacggaaattaccgtctatatccgtgatagcgccaaccgtagtcccctcgatcacgaccgaggcgccgatcaacggttctttcatctttgcgtccgtaactgtcccgcagataacccctgtttgtgcccatagagagaatgacaggaaaactcccacccagaaaagccctaaccttttcaatcttttgccccttaaactctttcccattatcttactacttattatttcatctttgatttcgacgcaaaagtacgggggcggtatttcaaagatgtttagatccgataacaataaagacaacaaatgttacatttttaagaccgcaacttttccttatcgtttgacatagctaacgtatttttactacatttgcactcctgaatgcataaagacatttaataacatgaagaacattaaaattttcccgaaagactggttgcagttgcatccctataaacaaagcactcccgtggattcctattataccggaatagcgaaccgtatctacgatatcatggagaagaccgagttggtaaactccttcgagggcgaggaaacaaagcagatctgtatccgcatggccgcctacttcgaggacgtgatctccggcatggggatttggcgtgccttcatccttacccataaggagctatacggcaaatacctccccttctacactccggacgatcattattacgacgatgaggtgaaccttgaggacgtgcgtttcctcctttggcattatacccagcagtatcacggctatcgtaaaggcactttcgtcagtccggacaaccctgccaacgaatccaccggcatgcttatctacgacctgttctgcaaagagtggaccacggcgccggagaatacccgcatggccaagcttttcgcccttgatacccgctacgagcggcaagaggattacgaccgtctattgcaatggttccattacgaatcctatatcctgcctgagtcggcccgggaactgagcgacttcgcccacgaccgctggaaggagcagcccgacctcaaccaagagcagcttaacaacctgctcgttaacagccacggcatgatggcctacaccagcaagacctccttgctaggtctgacctccccgcaatggctggcaaagatattgcccgccgagcatcccgaccatgcggtatttcagaacaccgccaacgagtctgtagccaccctgcccgacgatatgctggaggaaaaccgccaacaatacgagactttccgcaaagccgcaggtgacaaactgcttctctatttcgacaagaccgaagacgcacaaacatttatcacggagacttccggccttatccccgccgagaacttccatcttcccgaggactggcaaagcaagaaactggcgatctacgccacgcccgaggaaggcgcccaagtcattacccgtgacgtggagctgatcaaggatgagaacaatcccttctacgacgccaaccgtgccgccaagcaagcgctctctttcttcatcgtgaaacattgcagcgtttacttcctgaaagagctggtagaccgaggtatgttggccgacgcacaaacaaaaagccttaccagcccggaacgtggcaaggcgatcatacaagagaattggaagttcctagcccgctatttcatccgggaatatcccaatagataaaacagatagaaagcaccatcgcaatctgcgatagtgcttcttttttagaagcatctttcatttagtaagtccacaaaccaaatacctttcaaataaaaagaataaacccagtaaattattacaaatagaaacatcagacaagatattcttatctttttcccgctctttcgccccggcaagcaatcacattatgtcattaacacctatatttgcaaaacaaattgacgcaataatcatttatacgcaaacataaggtcaacaaatgaaaacaaacagaaatcattttaatagcagacaaggattatacgacccgtcttatgaacatgacgcttgtggagtaggaatgttagtaaatatccacggcgagaaatcgcacgacatcatcgaatcagcccttaaggtactagagaacatgaggcatcgaggcgctgagggagccgataacaaaacgggtgacggagcgggaatcctattacagatccctcatgagttcatcctcctgcaaggaattccggttccagagaaaggcaaatatggcaccggactaatctttctccccaaagacgaggaacagcaagcaagcatcctcagtatcctcatcgaggagatcgagaaagagggattaaccttgatgcacttacgcaaagttcccgttcatacggaaatcttgggaaaggacgcacaagcgaccgaaccagatatcaagcagatattcatcatcggctgcaacgatcagcaagagctggaactaaagctatacctcatacgtaagcgggtcgagaaaaaggtatcggctaccgaccttccggccaaggatgatttctatatagcgtctctttccaccaaaaacatcgtttacaaaggcatgctggaatccatgcagctacgccattactttccggacctgacgcaaccttatttcactagcggactggccttggtacactcacgtttcagcaccaacaccttccccacttggagtctggcgcaacctttccgcctactggcacataacggggaaatcaacacgatacgaggcaaccggggatggatggaggcccgggagagcgtactctcctcccccagaatcccggatatcaacgatatacgcccgatcatccagccgggcatgagtgacagtgcctcactggataacgtattggaattcttcgtggcctccgggatgagcctgccgcatgccatggcgatgctggtaccggagagtttcaacgagaagaacccgatctccgaagatctaaaggctttctacgaatatcactccatcttgatggaaccgtgggacgggcctgccgccctgctctttagcgacggacgctacgccggaggcatgctagaccgtaacggtctccgccccgcccgttacctgatcacgaaacatgacatgatggtcgtggcctccgaagtcggcgtcatggatttcgagcctaacgagatcaaggaaaaaggccgtctgcaacccggaaagatcttactcatcgataccgagaaaggcgagatttattacgatagcgagctgaaggaacaactggcgaacgcccagccctaccgtacttggctggagaaaaaccgggtggaattagacgaattgaaatccggccgtaagattcctcataaggtagagaaatacgacaagctactgcgtacgttcggatacagccgtgaggatatcgaacgtatcatcataccgatgtgcacgggaggggcggaaccggtcggctccatgggcaacgatacgccactggccgtattatccgcccgtccgcaaatcctctataattatttccgccaacaattcgcccaagtaaccaacccgccgatcgacccgatccgcgaggaactcgtcatgagcctgaccgagtatatcggggccgtgggaagcaatatcttagttccaaccgagagccactgtaaaatggttcggctgaaccatccgatcttgaccaatacacaactggatctcctgtgtaacatccggtataagggctttaaaagtgttaagctccccactttgtttgacgcagagaaaggatgcgcaggactgaaagctgccttggacgaattatgtaaacaagcggagcaatccgtcaccgacggcgttaactacatcattttaagcgatagaaacgtagatgagaaaaaagcggtgatcccctccctgttagcggtaagcgccgtgcatcaccatctgatctccgtgcagaaaagggtgcaaacagcgctggtagtggaaaccggcgagatgcgtgaggtaatgcacgccgccctcttactaggctacggggccagtgccatcaacccctatatggctttcgctatcttggatgatctagtagacaggcaagagatacaattgaattacgagactgccgagaagaattacgtaaaagccatttgcaagggtttattcaaggttatgagcaagatggggatcagcacgatccgcagttaccggggagcgaagcttttcgaggcgatcggcctaagccgggatctggcagatacttacttcgggggaaccaccagcaacatcggtggtatccgcttggaagagatagcggcagacgcgatcgccatgcacaatgacgcattctcccaccccacggattctttattggaacataaaggcatttattccttccgcaaggatggcgagaaacacgcttggaacccggataccatttccatgcttcaactggctacccgcttggggagctacaagaaattcaaggaatattcccatgtggttgatgagaaggaaagccccatattcttgcgtgacttcctgaccttcaaacaacgcaccccgatccccttggagcaggtagagccggaagaagcgatcatgcgccgctttgtcacgggagcgatgagcttcggctctatcagccgggaagcgcacgagacgatagctatagccatgaacaagatacacggacgcagtaacacgggcgagggtggtgaggactcggcccgtttcatctcccgtgaggacgggttatcgctccgctccgccatcaagcaagtagcctccggacgcttcggcgtgaccacggaatatctggtaaacgccgacgagatccagatcaaggtcgcccaaggagcgaaaccgggcgaaggaggacagcttcccggctataaggtgaacgatatcatagcgagaacccgtcactcgatcccgggtatctctctgatctctcccccacctcaccacgatatttactcgatcgaggacttggcgcaattgatcttcgatctgaagaacgtaaaccctcaagccgagatcagtgtgaaactcgtatccgagagtggcgtgggaaccatcgccgccggcgtagccaaggcaaaagcggaccggatcgtgatctctggggcagaaggaggaacgggagcttccccgataagctctatcagttacgccggaatcccacccgagctaggactatccgagactcaacagacgctcgtgatgaacggcctccggggacaagtccgcttgcaaacagacggacaattgaaaaccggacgggatatcgtattgatggcgatgctgggtgccgaggagtttggattcgccacctccgccttgatcgtcttaggctgtgtgatgatgcgtaaatgccatatgaacacgtgtccggtaggtgtcgctacccaagatgaggaattacgtaaacgctttcatggccgacacgaatatttggtgaatttcttcaccttcctcgcccgtgaagttcgggaatatctggcagagctaggctatacgaaactagacgatatcattggccgtacggacttactcatgcgtaaaccttccgatcatatcgagaaacatgatctattggatctcagccgcttgatccatctaccggaacaagccgccacgcaggccatccatcatgtcacccgtcaactccacgcgatcgacaacgtgaaagatgtggatataatccgtcacgcgaaggccgccatcgaatccggacaggaagtatcgttggattatgcgatagccaacaccgatcgttccgtaggagccatgctttccggcgagatcgccaagcggtacgggaacatcgggttaccggagaacaccctgcatatcaagttcaagggggcggcaggccagagcttcggagcctttctggctcacggcgtacatttccggttggaaggcgaggcgaacgactatctcggaaaaggattgagtggcggacacatcagtttaatgcctccggtacgctccacctttatagcggaagacaatacgatagccggtaataccttattatatggagctaccagcggtgaggtttatatcaacggccgggtcggagagcgtttctgcgtgcgaaactccggggcgatcgctgtcgtggaaggtgtaggcgaccattgttgcgagtacatgaccggaggccgggttgtcgtcttaggcaatacaggccggaacttcgccgccggaatgagtggtggtgtcgcttacgtgtggaacaagaatggtgatttcgattactattgtaacatggaaatggtagagctttccttgatcgaggatagcacctcacggaaggaacttcatgaattgatccgcaagcattatcatcataccggcagccatctggccggattgatgctcgataactggaacaagtacgtggatgagttcatccagatcgtcccgatcgaatacaagaaagtactccaagaggaacagatgcgcaaactccaacgcaagatcgcggagatgcagaaagactactaaatatttacacaaaaacaagagaactatgggaaacccaagagcatttctaacgatacatagacaagaggcgggctatcgtcccgtccacgaacgtatagatgatttcagcgaggtagaacagaccttgaacagcggcgaccgccgtacgcaggcctcccgctgcatggattgtggcgtacccttctgccactgggcctgcccgctgggtaacaagcaacccgaatggcaagatttgttatacaaaggccgttacaaagaggcctatcacgtattagagcagaccgacgatttcccggagttcacgggacgtgtctgccccgccctctgcgagaaaagctgcgtactgaaacttagctgcgacgaacctgtcacgatccgtgagaacgaggcggctatcgtggaagccgctttccgggaaggatacgtacagcctatccaaccggtacgcaacgggaaaaaggtagccgtgatcggtagcggtcccgccggattgaccgtagcgaaccaattgaatcggaaaggatataaagtcaccgtattcgagaaagatgagttaccgggcggcttgctacgcttcggcatccccaatttcaagctaggcaagcacattatcgatcgccgtatccgtatcatggagcaagaagggattcttttccgtgtaaacacgatggtcggcaaagatatattagcgaaagatgtagtgaaagatttcgacgctgtttgcgtagcgatcggcgccgaggttccccgggatctatctatcgagggacgtcatttaagaggcgtacatttcgccttggagttattaagccagcagaaccggatcttagaaggcatcccgcccaaaagccagatcaattgcaaaggcaagaaagtcttagtgattggcggaggtgatacgggtagcgattgcgtagggacagcgaaccgtcatggggcggcctgtgtcacccagatcgagatcatgccccagccacccgtcggacagaatccggcgacaccttggcccatgtatccccaagtactgaaaaccagcagcagccatgaggaaggttgtatccgccggtggaacctagcctctaaccgttttatcggagagaaaaacaacctgataggggttgaggtagaagaagtcgaatgggttccctccccagacggaggccgtccgcagatgaggctgaccggcaagaaagagatcatcgaggccgatctggttttcctcgccatgggcttcctgcatccggagcaagaaggattgatcaaagaactacgattggctaccgacaaccgcgataacatcgccgtagacaacgccggatataccgccaacagcaacctatttgcctgcggagacgctgtcagcggagcgagcctagtcgtaaaagcgatggcctccggccgtaatgtcgcccgatccatcgaccgtttcttacaaaccaactaattttcaactttcaatttttaatgatcatgtgtggtataacagcgatattcaatatacacgacggagcgcaagccctgcgtaaacaagcgttattaatgagtaaacgaatccgtcaccgcggaccggattggagtggtatctaccaaggcaaaaccgctatcttagcccatgaacgcctttccatcgtagaccctgcctccggagggcagcctttggtcagccccgacgggaaactcatcctctgcgtcaacggagagatctacaaccatcaggaattacgagaacggttaaaaggcgattacgagttccaaaccggctccgattgcgaggtgatcctcgccttatacaagaagaaagggattgatttcatcgaggatctcaacggtattttcgccttcgctctctatgacgaggagaaagaggtttacttgatcgcccgtgacccgatcggcgtgatcccgctctacatcggatacgatgacgagggacacttgatggtatcttctgagttaaaagggcttgaaggcttcgccactcattacgaaccattcctccccggtcattatttctatagcgaagaccggaaactcacgagatggtacacccgtgactggatggattacgccaacgtgaaagataatcctaccgacgtacaacaacttcacgatgcgctggaagccgccgtcaaacgccaactgatgagcgatgtcccttatggcgtccttctatccggaggtctggattcctccatcacctccgctatcgccaagaaatacgcagcgaaacgcatcgagaccaatgggaaagcggacgcatggtggcctcaactccattcgttcgccatcggattgaaagatgccccggacttgatcgccgcccgtaaagtagcggatgcgatcggtacggttcatcatgagatccattatacgatacaagaaggattggacgctttacgagatgtcatttatcatatcgagacctatgatgtcactaccgtccgagcctctacccccatgtatttattggcccgtgtgatccggagcatgggtatcaagatggtactaagcggcgagggtgcggacgaggtattcgggggatatttatatttccataaggccccggacgcacaggctttccatgaagagaccctgcgtaaattaagcaaactgtatttatatgattgcttacgtgcgaacaaaagcctttgcgcatggggcgtagaaggacgagtgccgttcttggataaagagtttcttgatgtggccatgcgtctgaatccggcggcaaagatgtgcccgggtacgaccatcgagaagaagatacttcgagaagcattttccgacagcttgcccaaggagatcgcttggcgtcaaaaagagcaattctcggatggggtaggctatggctggatcgatacattaaagaaaataacctccgagtcggtcactgatgaagagatggcgaatgccgccaaacgattcccgatcaatccgccccaaaacaaggaagagtattattaccgctccatctttgaagagcatttccccagcgaaagcgcggcgagaagcgtaccttccattcctagcgtagcgtgttctaccgcagaggctttagcttgggactcggctttcaaaaacatgaacgagccaagcggcagggccataaaaggcgtacatgaatccgcttattgacgaatatttcttttctttagtagcaaaatgcaccaacttttatgaataataaacgctggtgcatttaatttttataataactttgccagctagagtcataaaacactttaatacaaatttatatgaagaaaatctttacatgcattagtttggcagccgctacattcatggctaccaccccagtgatggcacaacaacaaaaacttacggataaggaaaaagctgcagttatagaagctattgtgcccgctatgtttgaacaggtaaaacaagtaagcggaatcgatatcatagaattggcaaagcccaacattgagaatgtattaagttctcctgtttttgggacagccagcacattacgagcagagacgcttatcgcaaatcctattacagttcaaccagatagtatgaaagtaaatctgagtgaaataagtaaagatattcccgctatgttcagtcagatcacattaaaaatgtctaattattacacagcaaatctttcatcaactaatggattaccaatagaactcaacttacctaaaactatttcaacaacaattctcggctccactgtttctttaaactttgaactaggaaagcaaacaggacttttaccatttgattcattcacagctaagttagatttaggcggattgtccgagttagccggagtaatgggaattaaaggtggagagttattctctttaaaagaaaaagcgactaatgctggtatgttcgattacaacgtaacgataggcgaatccttacgtagtgtgatcgctcttttggaaaaagacgaagaggaaaaaactaccatcccaaacttccttatcaaaaccaatatgacccaacaggccaaaggtttagttgaggcatcattatatgctgtacctacaactagctctactgtacaagtaccgatgggtgatgcccaagtttatctgaatcttaaagcggccgctactggtaaaatgtctcccgattcaattctcttgacatcctacaagaatggacaaaaagaaggttatcgtaagctagctactaagatggagcaaaaaggccagaattttgtgattacctcacaagattccacaaaaactttaaatgcgacagaatggaaatggtctgcaactgaaacgataacaatgactaatcgtacgaatgcaaccgaagcaaaagcaatcgtagccgaaactattactcgtgctatcgcagagttagctgcaacaggaacgactaatccatacagcatggttgtaacaaagacttccgacatgaatggggatggtcaagtagcagccgcagaaacgatcactctattaaaagctgacgtaactacagcaatgggaggatcagtgacagctcccgctatgaatgttgcggttaagatacaaactcctaatgatacagacggacaattgaccgaaggcatggatatagctatcaatcttccgttaaagggtgacaaggtagtagctgatttcacaccagttggatacgataaacctgtcgctacaatgtacgtaaaatctgacgctatgggtatcatcacagacaacgagactatcgagaatgatgtcgaagaggttaaggtttctacaaccgctagcggtctttatgtaaagaatggtaagggtaattatgtaatcgttaatatggtaggcagagttgtttctacgggtatcatcactagcgatgagcaatacatcagcactccgaatatgccgaacggtatttatatgatctcaatcgatcagtctaagctcttgagatctgctcataagacaactgttaagttcgtaaaataaattatctagataattagttaatctgataaaaggagctatccggaaacaaaaccgagtagctcctttctttttgtcaatttgtaaaccaaactcccggagagttgatttttctggcctgatgtacttctcgtccctaaatatgagaaaaaatattagcaaatgattgtttagtaatatattagccaaatacgaccttttgttctagagaaataattcatgctagttcacatttatacgggtcaaaacatgttttttatacggataaaagaggcatttcatacggttgtatcgcccgacgcgactatatgtatcgccttacgcgacctatcgcgttggctaacgccactacttgcgtcgcccaacgcaacctttcgtgtgacaaaacataaccttttacgtagaaatcagtggttaaatacgtattttcacccattatctatccctagttgaggcttcttaaaaaagaggctcgtcagacaaacagacttattttaagcaaatagatagatatatagcttttttacttacagttacagcaatccatattcacaaagcatatattacgatataaaaccaaaatacacacttctaattatcatttataactaaaagcatatattacaacttcaatctattacaaacctcatatttataaaacattcgagcctctcacctgttatatacttatcaaaacgttatatatttgcattacaataaaacaaaaagaaataatataaagaataatatcatcaaaatgacaaaatcaatcagattcacaaagatgcacggtgccgggaatgattacatctacgtaaacacgatggcctatccgatagacaatcccgaggaattatctatcgcatggagcaagccgcacacgggcataggatctgatggtttggtcttgatcggttcttcagacatcgccgatttcagcatgcatatctataatgcggacggctccgaggcgatgatgtgcggaaacgcatccagatgtattggcaaatatgtctatgaggccggcctaacgcaaaagaacaaggttaccttagagaccttatctggtatcaaagagctacaattgaaaatagagcgtgaagaggtcaccgagatcacggtagatatgggaatgcctgccgtaggcgagatcgccttggaggttgaggctggaggagaaatttacaccggcaccgtcatctctatgggaaatcctcacttggttatcttcgtggacgagatggaccaggccgatctggcaagcgtaggcccgttactggaatgcctcccgctttttccggaccggacaaacgtggagttcgtgcaggtgctaaaaccggacgaggtacggatgagggtgtgggaacgaggttccggcatcacccaagcctgcggaaccggagcttgcgccaccgccgtggccggggtcgtacgtgggaagacaaagcgaaagacgaaggtcatcatggatgggggccctttaaccatcgagtgggacgagcggagcggtaaggtctttatgaccggcggagcggtcaacgtgttcgagggattcataaaagtctgacacggggaacaagacaaaacaacgaaaacaacaacataaaaacaaaagaactgagtatggcactaattaatgaacatttcctgaaactacagaacaattaccttttctccgacatcgcgaaaaaggtaaacagcttcaaggttacccatcccaaggataagatcattcgaatgggtattggtgacgttacgcaaccacttgcccccgccgttatcgaggcgatgcataaagccgtggaagaaatggcgagcaaggatacattccacggatatggccccgagcagggatatcctttcctaatcgacgctatcattaaaaacgattatgccagccggggagtctttatcgaaccgagcgaggtattcatcagcgacggagcgaaaagcgattgtggaaatataggcgacatgctccgccacgacaatagtatcggggtgacagaccccgtatatccggtctacatcgactcgaacgtaatgagcggacgcactggggtattggaaaacgggaaatggagcgatgtcgtatacatcccttgcacggaggaaaacaacttcgtaccggatctgcccagtcgcagggtggacatcctttacctctgctatcccaataacccgaccggaacgaccttgactaaggacgaattgaagaaatgggtaaactatgcccttgccaacgacgtgcttatcatgtacgactccgcttacgaggcttatatacaggacccgaatatcccccactctatctacgagatcaaaggagcgaagaaggtagccatcgaattccggagcttctctaaaaccgccgggttcacggggatacgttgcggatacacggtcgttccgaaggagctgaacgccttcacgctggacgggcaacgggtacagttgaacaaattatggaaccgtcgccaatgcacgaaattcaacggaaccagctacataacccaacggggtgcggaggcggtttattccaccgccgggaaacagcaagtaacagctactatcaattattatatgaccaacgcgaagatcatgaaagagggcctgcaaaactgcggtctcacggtgtacggaggcgataacgccccatacctctggctaaagaccccggacggcctctcctcatggaaattctttgacaaactgctttatgaagtcaagatagtcggaacccccggagtgggattcgggccgagcggggaaggttatctacgcctcaccgctttcggcgacagggatgacaccctagaggccatggctaggctgaggaagtggctaagataagtcatttactataaacaacaataatcatcaggtattatgtcaaagttaagatttagagtcgtagaatcggcgttcgagaaaaaagcgaccgagctaaccactcccgccgagagaccttccaagtattacggcgagctggtattcaaccgtgagaagatgttcaaatatcttccagagaaagcgtacgagagactggtggactccatcgacaacggtagcccattagaccgtgagacagcgaacgccgtggcctccggcatgaagaaatgggcgatggaaaaaggcgctacccactacacccactggttccatcccttgacggaaggtacagccgagaagcacgatgctttcatcgagcatgatggcaaaggcggcgtacttgaggaattcgagggcaaactactgatccagcaagagccggatgcctccagtttcccgaacggcggtatccgcaatacgttcgaggctcgtggctactcggcttgggatccttcctcccctgcttttatcgtaggcgacaccctctgcatcccgacgatcttcatcgcttacacgggcgaatccctcgactacaaagcccccctactgaaagccttggaagccgtaaacaaagcggcagtcgatgtctgtcactatttcaacccggacgtgaagaaagtatacgcctacctcggctgggaacaggaatacttcctagtagacgagggcctgtacgccgcacgtcccgatctgttgatgaccggccgaaccttgatgggacatgaaagctccaagaaccagcagttggaggatcattacttcggcgccatccccacccgtgtcatggaattcatgaaagacctcgaggtagaggcattgaggctcggcattcccgtaaagacccgccataacgaggtcgccccgaaccaattcgagctggctcccatcttcgaggaatgcaacctcgccaatgaccataacttactgatcatggccctaatgcgcaagatctcccgcaaacatgggttccgtgtcctgttgcacgagaaaccgttcaaaggcgtgaacggttccggcaagcacaataactggtcgctgggaaccgataccggaatccttttgatgggaccgggtaagacgccagaagacaacctgcgcttcgtgaccttcgtggtcaacgtactgaaagccgtgtacacccataacgcattgctgaaggccagcatctccagtgcgaccaacgcccatcgtctgggagcgaacgaggctcccccagcgatcatctccagcttcttagggacacagttatccaaggtattggaacatctggagaacagcgacacggaagatttcaacctagcgggaaagcaaggcatgaaactcgatatcgcccgtatccccgagttattgatcgataacacggatcgtaaccgtacctcccctttcgccttcaccggtaatcgtttcgagttccgtgccgtaggttcctccgcgaactgcgccgccgccatgctggtattgaacgccgccgtagcggatcagttgaggcagttcaaggccgaggtagacgctaagatagccaccggaaaggataagttcgccgctatcatcgaggtaatccgcaaggatatcaaggaatgcaaggcgatccatttcgacggcaatggctacagcgaggaatggaaggccgaggccgcacgccggggcttggattgcgagaccagcgtgcctttgatcttcgacgcttatttgaaagatagcagcgtccgcatgttcgagtccacgggagtcatgacccgcaaggagctggaggctcgcaacgaggtcaaatgggagatgtacacgaagaagatccagatcgaggcccgtgtattaggcgacctgacaatgaaccatatcatcccgatggccaccaaataccagtcttccttgatagacaacgtatataagatgcgtgaattattccccgccgataaagccgcccatctatcctccaagaacatggagatcatcgaggatatagcgaaccgcacgatcttcatcaaggaaaaagtggacgagatggtcaacgcccgcaagatagccaacaagatagagagtgagcgggagaaggcgatcgcttaccacgatcggatcgtcccgatgatggaagccatccgttaccatatcgacaagttggaactggttgtcgacgaccagatatggaccttgccgaaataccgtgagcttttattcatcagatagtcttattcagacagtagttttttgttgattgttttgtgttaataaggagaggatgctgcgaagtatacctctccttcttttttatcccatacaaaatacatacctttggggcataaatatataggagggaaattgatatgacgacaatagagttacaacaatggagagaaagctttatcgagaggtatctcaataaaatagacgatatggaaacggtcctaaagatcgagaaatatatgaaacgaattatgtccaaggcgaatgcagcatctcccatttcattcagtttgaaagaagccaatagggaaatagatatagccgaacaggagctagaagaaggtaaaggcatcaatgaggatgatatgcaccaattctttgagacatggagaaacaagctaaagtaatctgggcaccccgtgcgaaaagacaagctgatttagccatagcctactgtttaaagcactttgggaaacaagctgctctcaactttatcgataagttggagaagaattgtatccggataaagaacaatcctcttattggtactatagaagagactttcgccgatagagacaaggaatatcgctccttgatcgagggacatcataaacttatatatacccaagaaggaaaacgttccatacgtatcgtattgttgtgggactgtcgtcaaaactccgataaattaagaacatctatcagataaacaataacaaatatgaattacggattcgtcaaagtagcggcagccgtaccacaggttaaagtggctgactgcttttataatattcaacagattgagggattgatgcgccaagcgtcccaaaaagaggtccagatcatcgccttccccgaattatcggttacgtcttatacttgcatggatttgttctcgcaagagaccttactcagaaacgccgagaaagccttgctggatttagtgaacaacaccgccgatctggatttactaacgatcgtaggttgcccgcttgtcagcgggagccaactgataaacgccgccgtcgctttccaacggggcgagatattgggggtagtgcccaaaagttacctgcccagctacaaggagttccaagaagagcgttggttcacggcctcttcacacctacagcaatccatgatcacgatcggtaaccgggaagtgccgctggattgctacctgatcttcgagtatgatgaggtacgtgtgggtatcgagatctgcgaggatctttgggttcccatccctcccagctccgagctagccatgcagggggcgaacttgatattcaatctatccgccagcaacgagttgatcggtaagcatgcttacttacgatccttgatctgccagcaatccgcacgttgtatcgccggatacgtctacgcttccgccggtttcggggaatccagtaccgacctcgtattcgcgggaaacggtatcatagcggagaacggcacgttgttaagggaatccgagcgtttctccatggaggagcaactcgttatcagcgagatcgatatccagaacttacagaacgaccgacggatcaacaccagtttcatgcagggttatctcaaccataacatggataacggcaccgtagtctcattcagccttcccaaccggacactggatttgacccgggcaatcgacccgcatccctttaccccttccggcgatgccttgaaagaacgttgcgaggaaatattccatatacaggtagcgggactcgccaagcgtgtcctccatgcccacgcccaaaccgccgtcgtaggcatctctgggggactggattccaccttggccctactggtcaccgtcatgaccttcgataccttgaagatcccacgggataagatcatcggcatcaccatgcccggcttcggaacgacggatcgtacctataccaatgcctgcgacttgatacgctcccttggcgtgaccctccgggagatctccatcaaggaggcttgcatccaacacttcaaggatatcaatcacgacatccatgtacatgacgtgacgtacgagaacagccaagcccgcgagcgtacccaacttcttatggacgtagcaaaccaagagaacggccttgtgatcggtacgggagacctctcggagcttgccttgggctgggctacttacaatggcgaccatatgtctatgtacggcgtcaacggtagcattcccaagacattggttaaatatctggtggaatgggtggccaataacaaggtagacgaggcttcccgcgccacgttattagatatagtagacactccgatcagcccggaattgattcccgccgacgagcatgggaatatcaagcagaagacagaggatttggtaggcccgtacgagctgcacgatttcttcctctatcacttcttacgcttcggagccccacccgcgaagatttatttcttggcgaagcgggcattcggggaaacctacgacgatgccaccctcaagaaatggctccataccttcttccgccgcttcttccagcaacagttcaagcgcagttgcctgccggacggcccgaaagtaggttccatcagcctctccccacgtggagactggcgaatgccgagcgacgcaatggctacgctttggctggatgagatcgcagggctttaacattttttcaatggtatagtcatagacgaggctctcttatgggccatagacgagacacctacccctataagagagcctaatctatgacctatgagagagcctcgtctctcacccgtatcaaccgaggccctaacatagatcgtaactaatcgaactgcgtaatcaccctgcgaatccgggtgaagctatccgtatccttctccagtttatagatgtgcttataggacagagcatcctgctcggtcggcgaaccattgatcaagagaatatcccggtcgttggcaaatttcaagatacccgccacgttgttcgggtgcagcttcccgatctcatccatcatgcaatggagcttgaaatcagagaataccgtggaggcgttccgcttgaacacgttcagcaacatgatattcaccatggatttgaccaagatatccgtaccctcggagcctacgttcgtaagacgttctacgaagcccgtatcattccggttctcgatcacccggaatttaaggtcgaagaagtccgccaagcggatcaagttgccggaataagcgtccatcgacttgatcaactcacgtagcaacgtcgtcgccttctcccgggtagccgtatcgtcggccgaggaagcgaacaggttctgccccaaatcccagctatattcctcgttgaatcgcttgatctccttcaacagattgacgatcttgttctggctcggatcaatacgcatctcgatacactggataatccccacgaagttcttctccttgaaatcggcgttgatctgatccaccacgccacggatattaccttcctgagagaccatgcttttcgtgtccgccgtaatctgccggaagatatcggagttgcgggtattgatacgcgattggtattccgagaccttatcctcgtcgataaactccttcaagtcgcaagcgaaatccatatactctttatcatccgagaagctcgtcttgaaggcgaacacattatcctcggagaaattgccggtgtaggcggttatctccttgcgcagctcggaaagtttctgggattgctcgctgatgcggatcgtgatctcccgtaccaaggaacggcaatcgccatccgtatcggtacggttcatggaagagaagatggattccctagaggtaaaccagtccaacagggtagagcggtgatattcctcccggttctccaacgctttccggttggcctccttcagctccttcaactcggcatctaccttgaagatactccggttcacgtccgccagacgttttttcaattcctcccgttccccgtggatgatctgctgcaagcgcaggctctccgccgtccagtcgggtaccttatccagcatctctcgtttatctttcagatactcgataatcaatgccttggtctcgttgatatatttaatctccccaccgatatacgccaagcgggaatggatctcctccaaacgtttcggatcgccaccgctagcggtcaagctatccaattgctccctgtcatatccggatttgcgctcttccaactccgctttcttgcgtacgatctcctccgagatagcttccctcgcaacggagagttccttatccaaagcagccaactcatctttctcttgctcatccaaggaagcgagttcccggtccatcttgccttgaagcgtggcgatctcctgctggatcgaggaaaggacggcctcggcagcgttcaactcctcctccaagcgccggatctcctcctgcctgagacggatcgcctgatcccgtaaggccgacagacgagactcgtcttccttcttgcggaccgccagttgttccaactcatattccgcatgatagatatcctccttgatgggcttcaccgaggattgatattgcttgcgaagattctctttagccgcctccaaatcctgccgcgccgtagcgatgaaccgctggattccggcacgtttttcctcggcctccttcttctccgtcaagtaatcctccttggtcttgacattccggtgaatcccggaggtgaagcggattccataaaaggtatctccctcgcctacctccgccgtaaactctttcccgtaaagcagacgctcgtcacacacttgcccgatcgtctgctcccagccgggcttatgctcggacagccagttgaagaagctatctttctggttatccaagaactccgtcagttccgttagcttagcgctcagggcctcgatcttcacctcgttggattccgctagcttttgataatcctcatccagatgcttcccggcggtctcgaactctttcgtctggtagttcaactcgtacttcagctcacggatcttcagctccaagtccttccggttcgcatcgtaattgccgagacgccccttgaccgcctccaattcctccgaggttcccgactgcccccgggcagtcttgatacgcatcttcaaggcggcgacctccgtcgtacgtttctcccgatccaccaacaaacgctctttctcctccgaggcggcatggcgcgattcctcccgtagccgtcgataatactcccggcgagcctcccgacgagcattgatctcggtctctgccgccagtaattgtttctgtttctcgttctcgaagccggccaactcgttcttcagattagcgatcaaattggcgtgcaagaccgaggcttctttattcttggaagaaagcaaatctttctccacgactaaggattcctgttcctgctgtaagatctccaatttgttacaacgatccatcgccgtctggatatctttcccggcatagaaaacccgtttcgcttccgcctctgacaaggagtttttcagcacggccaactcgccttccatcgtggctgtccggttcttcgattcagcgtctagcttatccctttgcttatagaaatccgatttgaccgcctcctgctcgtgtatcttccgggacaactccggcaagatacgctccgtttccagataagccccacgtaattggcgacacagatcgttgatccgtaaatcccgcttacggatatcgtccgacaaggtggagatcccggcggccttccgcaccatgcccggctcacggaaaacaccgatatcattcagttgcgcctcaaaaccggatagatggctccggtaacggctcaagtcgatcacgctatccgcctcgttcaaagaggtgatgatcgtctgcttgatataatccgcctccaagcgtgagttcagcaagacgttctggatcgtacggatgatattctgatacgagccgctctccatcaaggaataacaggagtaatcccgtttattatccgagtttccgtagaggatattccggtattcctcatacgtggagatcgccccgctatacttgataccgttcttatcgagcaccgagcggatacgatccgacggataaggcgctccctcctcgtcgataaaaagatccggccggtacggagaggcgataaaacggtagcagatacggttcatcgtcttatagctaagtaccgtaaaccaaccatcctccctcgctacctcgtagatgatcgaggaatcggcataagggaaataataatcctgatacgacttcttctcgaccgggattccgagccgctgcgtatcggcgttgtaaaagaaaaggatcgcacggaggatcgtactcttccccactccctgcgttccgattaaatgtatatttccatccagctgtacttccgagtaacggatagcggcgctgtttataaatactattttattgagatatctcatcttcgttctttatgttaatactatggatcatcttcgtgaggtaatcccacgaggagagcactttccacgtcccgttcatatcgcttacgcactcgataaagccctctttcgtcatcctgtccaagatggtatcgaggatatccttgcgtttctccttgcctccggtatgttttttcaacccgtccagcttcatctccagatccatgtcgatccgggaacgtaccaatatctccgccggcgagaaggtgaaaccgggcccgaaggccgtatcgtacgtacagaagaagtccatgatatcgatccaagcgaagaaacgctggagcttttgctccaaggtagcccggggctccttgcgggagaagtagaagtaattattcccctgctccaacacgaaattgatatgcgagaaataatcacgtaaacgctcaaaattatcttctacgaccgagaagagtgtcctcaactcctttacacttgtattcgagcacagaaaattacctttcgacaggtaatcatagatctgtgcggtctgtaccggtaaattatctatcatccttattattgttgttttattttatccagttgtagagacggggcgtgccccgtctcatcacagggggcacgccccgtctctacaactaggttctttgaataatggcatattctatatgctccatatgtccaaaacggtctgttatctccaactcattttcatagagggagagcaaacggcaaaataacgtaaccttcgcctcgaaatccatctcccggttatactcgtagcccatcacgaaagagaacaaatcccctccggtccggctaaaaacatccatcatcttccgggtattgatagcggcctcccccacttcttgattctccatctgctcggcggagatcacgcctagctcctgccggtggatcaccttgtccggccgtatgccgtcggccaccttcaagatgacatccagcgcctcgtccgtttgcaaataaggaatggaaaccttgaataaggtaggctgcacgccctccaataccacggaacgctccgcgtctaccacctcccgtacattcgtgttctcctgtaactcaaactgctcccgcagatatttgatacgacgcagcttacgggtaaaacctacctgcgtacggatctggttcaagtaatcaatgatatcctgttgggaatggatcaagctatggccggcgctcaacaactccgtcttcaactcacgggcgatcgtcaacagctcctcgtccggggcttgggcgaaaaagggagtccgttcccgatccagcagcttctccacttccacgatcaggcggttgatctcgattcgcttagcgtccagattctccagtttggcgatcttcaccttatagctcggctcgttcttgaacgtattatcgatcacccgttgcaaggacaccacgttacgtaccaagatcttcccgatcttccgcaaatgcgccttgaccgatcgcagatagcccagcttacgcaaatcgttatcctccttgctataataatcgatcaattgatacaccaactggatattctcatcgatcaccgaggtagaaatctcctcattcgcctccagaagcagctcatagaaagagagataatgctcatccatctcgatataagggccgttcctgcggatcacctcacgctcgatcaggatattcaatttattctcatcgataatatccaacgcataatcatagcgaaacggtaatgattttcttttctcaaataagacctccaataggtcctttcccagatttagcgtgttcgttatatggggtattgaattatatatgtacatcctaaacaattaaggacacaaaggtaataaaaatacaagtaacccttttttctccgtgatgaaaaaggatttccatcgtagtgaaaaagctttttcatcacggtggaaaaagtttttcaccccgatggaaaaagaggaaaatcacgaagagttatcaatccgccggatacaaaattcccaactgccggcgtacttcatcgataatctccaatgtaatcaaagaattatcaaggctattgatttctgactcccgcttgccagacaagacgaggttgataaattccgctacctcataatagtactcatccttatcggcgaccacgcttaggtcttccggaaccggttccgggccttttcccatcgccggagctaaacggggagaatacgtcactttacggatgatattgatccggtccaaggtcaagttcccctcctccccttgtatctcggtaggcaaggcggagttggcgatcttagaataaagcaccgtggcgttcatcccctcatacaagaaattcacggccccttgcccgtccgctcctgaggacaggactatgcccgaggcatctatcttctttgggcgaccaaacaagacaaccatcggatagaccgtataaataccgatatccatcatggccccattagacaattccggcttgaaagcgttcaacacgattccttccttgaacttatcataacgggaggaatactggcaatagcaggcgaaataacgacgaaccgtacctacacgcccaagattctctcgcacggcaagaaagttcggcgtaagcgtaggcttcatcgcctccatcaacgtgacattatatgtacgggaagcctcgatcatcgcacgtacttctttcgcgttggaagcgaagggtttctcgcaaagaacatgcttgccatagctcatgcaaataatactctgggaggcatgaaggaagttcggggaggcaatatacacagcgtcgatcaacgggcttttcgccatctcctccaaggaggtaaacgtatacggtatattatgtttcgaggcgaaagcatccgccgtctcctgagttctcgaatatacagctaccagttcaaaacgctcatcctgccgggctccggcaattacccaatcacttatgaaattggttccgactacaccaaaacgtactttatccatattctatcgtattatgttctttatttacaaatgtacgatttctgtttaacataaatactccgtggaaatgttattgtatctataaaaaggataagtcacaggaactttttcgcgacgacgctgtttaatctatacaatttaaaaccgttttaaaactaaatcaagtatgaaaagaattgtatcttttatcgtcgttctcgctgtcgctatgtgcggaatgacacaagtaatggctcaaaaatcgataacaaaggaagccaaaaaagtagagagagaaatcaagaaacaagagcgtctggcacaagatgccgtagaaggccaagaagagtttaacgccgctgtacaagctatcaacaaccaatcattcgtattggaggctaacaacatacaaccgatgaacggacaggtattctacgtaaattcaaatacgaacttcgtatctttgaatgacggacaggctatggtccagatcgcgtccaactctccgtatcccggtcctaacggattaggtggtatcaccgtacaaggtagcgcctccaatatccagaccaagcaggatgacaaaggcaatgtttatctgaacatgaacgtacagggtgtgtttatctccgctaccgttagcttgatgcttaccaacggaacaaacaacgcgaccgttaccgtagacccgaacttctccggtagaaacttgagaatgaccggtaccctacttccgtactcacaatcgaacattttccagggaacaacatattaatcatgtccaacttttctataataaggaaggcggtgctccgtgaggaacatcgccttcgaactatttatagatagccttatctcttatttacggaaaggagcctttaccacttgagccttcaagttcttattacgcaccttgataaagatatccgtaccagctttcgcaaactcaggtttcacgtatcccataccgatccccttcttcaataccggagacatcgtaccggaagtaaccacgccaattacattcccttccgcatcggcgatctcatagccatgacggggaattcccttttcctgcaactcgaaagcacacaacttacgggttacgccctctttcttctgacgctccaattccgcacgattcgtaaagttcttaccctcggcgaacttcgtgatccagcctaaaccagcctcgatcggagaagtcgtatcatccaaatcatttccatacagacagaagcccatctcaagacgaagtgtatcacgtgctcccaaaccgatcggcttgatcccttccggctttccagcctcgaagatagcgttccaaatcgtcatcccatcactcggatagaaatacaactcgaagccacccgcaccggtataccccgtgttggagataatcacgttcttgcaaccggcgaactcacccgtcacaaatgaatagtaaggaatagaagataaatcaaccggagtaagacgttgaagaacctcctgtgctttcggtccttggatagccaattgagccgtacggtcggaagaattctccaattcggcacctaccgtattatggcttacgcaccaatcccaatccttgtcgatattaccggcgtttacgaccagcaaatatttctccggctcgtaatgatataccaaaaggtcatccacgatacctcccttgtcgttcgggaagcaagtatattgagccttgccaagcggcaagacagaagcgtcattagaagttacgctttgaatgaaagccaaggcgttcgggccttttacccaaaactcgcccatgtgggaaacatcgaacacacctacaccattcactacagtcatgtgttcgtcgataattccggaatattcgataggcatattgaaacctgcgaattcgtgcatcttcgcgcccaaggcgacatgcacgtcggtaaacggagttgttttcatgtaattattgcatttaagatttacgagccgatagctctatgatttttataactgtttccatactcttctccaacgaacgaacgggcaagaactcataacgtccgtggaaattcaggcctcccgcaaaaatattcgggcaaggcaatcccataaacgacaggcgggcaccatccgtacctccccggatcggtttcacgatcggttctaccccaacggaggtcatcgcctcaaacgccaaatcaacgatatgtttctggggctccacaacctcgcgcatattgtaatattgatcccgaagctctaaatgcgcacatcccggatgcgcttcattcatcttatcaaccaacgtacgaagcaattctttcttctcctcgaataacttccggtcatggtcacggatgatgtaagatagagtagcttcctcgaccgaaccggtcataccggtcaaatggaagaatccctcataaccagtcgtatgctccggacgttgctcggccggcaaccaagaagcaaactcgatcgcacgcaaggaagcgttttgcatcttatccttggcatatcccggatgtacgttcaagcccttgaagataatcttagcgctggcggcattgaaattctcatattccaactcaccgatttgtccaccgtcaatcgtatatccccaatcacaaccgaacttctccacgtcgaaatgatcggcaccttgtccgatttcctcatccggggtaaaagcgatacggatcttaccgtgcttgatctccggatgatccttcaaatattgcatagaggcgacgatagcggctacacctcccttatcatcggcacctaataaagtcttaccattcgttacgataatatcctgtcctttataatccgaaagctctgggaacatcgattgagatagtacaacattttcttccgcatccaagacaatatcaccacccagataagtcacgatacgaggttgaacattcttacccgacatatccggactcgtatccaaatgagcgataaaaccgatagtcgggattttctcgtccgtattagccggcagagtagccattacataactattctcatccaaggagatctcctccataccaatcgcttccaattccttcaccaaagcctcggcaaagacacgttgtcccggcgtactaggagtcgtacccgtctcctcgttcgactgggtatcgaacgtaacgtactttaaaaatctatctaaaactgtcataactcactctttttagccattaaaacattgcaggcataaaagtaggtaaaatttttctaaaaacagcttgaaccatcaaagcaatgcgtacaaaccttacacttaggaaggtcgatcgcctccaccaaggtttccagcgtattaaacttcaaggaactcaacccgaaacgctcggcgataattccgaccatcttcttatattccggagagtctgtcgtagcatatttatccagattcttattctcatccccttccaattccttgataatctgacgagttatcaactccaaaggactcttggaagaagtaaaaccgataaacgggcaactataaatcaatggagggcaagcgatacgcatatgtacctctttcgccccataatcatataagatcttcacgttatcacgaagctgtgtaccacgcacgatcgagtcgtcgcagaaaaggatgcgtctgccttccagcatcgcacggttcggtatcaatttcatcttagccaccaaggaacgcatctcttggttagccggggtaaaactacgaggccacgtcggtgtatacttagcgatagcccgatgataaggcacccccttaccttccgcataccccaaagccatacccacaccggagtccggtataccacaagcgcaatccacctccgagtcatccttctgccccatcttatagccactcataaaccggacatcctccacgttctttccctcatagcaagaaacagggaatccataatatacccaaaggaaagagcagatctgcatcccttcattcggtttacgcatctgctccataccatcggcacgcaaacggacgatctcgcccgggcctataaatttctcgatctcataatccaagttcggaagactgctggactcgctggtcgccgcataagccccgtctttccttccgattacgatcggcgtacgcccccatttgtcacgggcagcgataataccatcctccgtcaggagcaacatggagcaagagccctttatcttattgtaaacattctcaatgccctccacgaagtccttaccttgtgtaatcagcaaagcgactaactccgtctgattcgtttttcctgaactcaattccgaaaaatgcatattcgccttcaataactcatcctccaattcgtccaagttattgatcttcgccaccgtcacgatcgcaaattttcctaagtgagagttgataacgattggctgcgcatccgtatcgctgataataccgaccccggcatttcctttgaatttaggaagccccggttcaaacttggtgcggaaataagaattctccagattgtggatcgaacgcgtaaatccttcttccttatcgtacgtagccataccgcctctgcgggttcctagatgagaattgtagtccgtaccatagaataaatccgtaatacagtctccattagaaatagttccgaaaaaaccacccattgttttttatgtttgtatttatgtttgagaccacaaagttacaagtttatttatatatgttccaaaatttacttcataacgtttattatcatcggcaataaaaaaaggataccccttttcgggatatccttttccttattctttggtcgcagaaacttaagcctcagcaacaacttcttttacagaaacgaatgatctgttttcttttcctctacggaaagtaacaacgccatctaccaacgcatacaacgtatgatccttaccgatacctacgttctcacccggatgatgaaccgtacctctttgacgaacgatgatgttaccagctttagcaacctcaccaccaaaaagcttaacacctaatcttttactttgtgattcacggccgttcttagaactacccacacctttcttatgtgccatttcttttcttctcctttaaacgttaagcaataacttctttaatactcacctcagtgaactgctgacggtgaccgttcaatttacggtaaccttttcttctcttcttgtggaataccagcaccttgtcaccttttaccagcggagataatacctcacatactacctttgcgccctctacagtaggaacacccactgttacctcaccgttgttatctactaacaacaccttgtcaaactccacaacagcaccgctttctgcgttctgaatgtgatgaacgaacaatttcttgccttgctcagccttgaactgttgtccgttaatttctacgattacgtacatctgtcttaaaatcttttaaacaggttaggtcccgggggtgggctccgtctccggctccacttatttaccctctgcggaaaatcgagtgcaaagatagaggtttttatttaaaggacaagggatgaaggaagaaaaaaaacatcataaaataacaatcgccttcaatctattatagatcgcaaataacacagggacctttgagataagctcgttcaatatagaaacaacatcattttctaataggggataatcatgggcgatctcgtttcgaagctcacggatataattccactcctccgccttatctatcaatcgatagcgttctaaaagatttaacaggtcacgcataggaagagagctaacatcctcatccagatattccaatagattccggaatattttggcccccatagcatcttgaagcttggaaaaacgaaagataaattgatccagacaacggatttgctcactattcaagcctacataatcctccaccgacataggtaaaagatctgccaactcacccaacgcctcttcaatacgctgtatatgtcgatcgcaaatctcaaactcccgattcagacgctgttctaattcttgctttttactcgtcataccaaacgtattccagtcattaatgcttcccttgctaccggtgagtcctcgtgatcacctattatatcgatcttctgatctcccaaaaagtatttcaaacgagccaacatccggatacgagctaatagccctttcgctccgaaaaacaacgaaccagcaaatttatatctcctcctttcttctcgtcattcagacgagacccaaagagatagacctctactccctcaccatatatttccttggcgacacgaagtattatctgtatttctttcttacttaaacgcatatttccaatgaaatacattttcttatagacaaagataacctatttcatgaaatagcacaaattatcgtctgaatttcagagaaaagtattttaccgacctatacactcataggtaaggccggcctcatgaagctcatgagcgtcgtaaatattacgaccatcgatcaataaggaattacgcataagtcttttaagtacagcccagctagggatacggaactctttccattccgtaactagcaacaaggcatccgcatccaccgtagcgtcatacatatcactcgcatagacgaccttgtcacccagcctacgtctgcactccgccatagcgatcggatcatacaccctgaccgtagcacccgctttcgtcagcaaatcaaccaagatcaaagaggtagcctcacgcatatcatccgtctccggcttaaaagccaagccccacaaggccaccgtcttgccggataagtctgaaatatgtttttgaagtttatgaaacaacacgttcttttgcctctcattcacctcctcgaccgctctcaagacattcatcgtatagccattcttttccgccgtcttgatcaacgcctttacgtctttcgggaagcaagaaccaccatagccacagcctggatacaagaacttactcccgatacggctgtctgaacctattcccttacgcaccatgttcacgtcagcacccaccagttcacaaagattagcgatgtcattcataaaactaatacgggtagccaacatggaattggcagcgtatttgatcatctcagcggaaggaacatccgtaaaaatcaagcgatagttattcatcatgaagggcttatacaacttctccatcagttttcgtgctcgctccgattccacgccgaccaccacacgatctggcttcatgaaatcatccaccgcatttccctctttcaagaactccggattactagccacatcaaactcaacagacacaccccgtttatccaattcctcttgaatagcggccttgaccttccgggccgtacccaccggcaccgtacttttagtcaccactaacgtatatttattgatatgctgccctaccgtacgggcaacctccagcacataacgcagatccgcactaccatcctcgtccggaggcgtacctaccgcactgaacaccacctccacgtcatccagaacggaggagagatccgtcgtgaacttcaaacgtccggcattataattcttatggaccatatcctccaagcccggctcgtaaatcgggatgacacccttcttcaagttctcgatcttctcggccatcacatccacgcacgtaacgtccacacccatctccgaaaaacaggtacccgttaccaaaccgacatatcctgtcccgacaatcgctatcttcataccgtagaatttatttttatagattataatatgatttgaaccacgccacggttcgattaacaccctcttgaatatccattgaaggcttaaaacccactgcctgttgaagcaatgtagtatcggcgttcgtctgatacacgtcccccggttgcatcggaagaaaatccttcaccgcctctttcccgcaagcgctctctatagcttgtataaaatccatcaacctgacaggccgtgaattgcctatattataaatacgatagggtgcggaggaggaactaggatccggatgctccgggtcccaatccggattcggtgtagccggccggtccaagacccgtatcactccctccacgatatcatcaatatacgtaaagtcacgtaacatatccccgttattgaacacctgaatcggacgatcgtgcagaatagcgtcagtaaacaagaaaggagacatatccggcctcccccagggtccatacaccgtaaagaagcgcaaacccgtggcaggaaccccatacaattggctatacgcatgcgccatcaactcgttagacttcttggatgcggcatacaagctcacgggatgagcgatactcgttttctccgagaaaggcacatccgcattcagcccatacacgctgctagagctggcatacaccaaatgactcacctgatgatacctacatccctccagcacattgataaaaccatccaagttcgattccacgtacgcatatggattcgtgatcgaataacgtacgcccgcttgggcggccagattcaccaccgcatcgaacccctcgttggcgaaaagcatccgcatcgcctgccgatcctccagattcatccggataaaacggtatctctcatacgtatggctaggagtcaatttataccaatccacttcctcttcccgtatgcccgcctccttcaagcgaccatacttcaaggccgtatcataatatccattgacattatccaaacccacgacctcgtccccccgctccagcaaacgccgtgcgatgaacgaggcgataaagccggcggagccggtcagtaaaaccttcataaatatgtaaattgaataacaatagaactaaaaagtctcaggaacatttctaagaattatcaatacatcaactcataaatcgccaaatgctttgcaatgacatcatccaaggaaaaatcccgttccgcaatctggcgggaattaagtcccattcgtttccttaaatctgcgtcatcaatcaaaatcctcaatttttccgctagtgccttgctatctttaataggaatcagaaatccattcaccccatcctctaccgtatccttacacccaatagagtttgtcgtgacgataggccgcccaatggctgtagcctcaatcaacgatttcggtaccccctctcggtaataactagggaaagctatgatatgggatgatctcaacaaatccggaacatccgatctatatcccagccattgtatataattcccatcgcaacgatcattcaactcttcctccttgatcgcttttgggttcgacgacaaaccgccacacaggagaaaacatacacgtccctcatattcttttcggagtaactccgcagcattcaccaatacccaaacacctttctcctctaccattctcgccgagaacagtatccgaatcttatcagagacaagctcaggagtatatgtatacgtctttagatccactcccgatcctttgatgaatcggatttgatctttagttaccactcttttctcgacaaacaaccgttcatcctcatgattttgaaatatctcgatcaaattctttcgatggtgcgagaaacggagaacactcaatatcaagcttgtcaaccgagattctttctctaatgaaaacatcacacccaatccgctgacagcgttcacaacacccttcacaccggctaatttagcggccagtccaccccaaaggatgaccttcaaacctacatggtgcacgatatccggtttctcccgcttataaagtcgatagagaaaccaaaaagtctttagctcctttatcggattcttccccgtaggatgaatgggtagttccagcatcttcaaacccaacgcttccacctgttccctacgcccggtattcttagccacgatcgccatgtcataacctgcctcttgcgcacgaacagccagttccttgcgatgcgtaaggaggaaataatcctcattgaggacgataaatattttttccattcttatctatttcgttataaggaactggcaatacgaactcttctcctaactcaaaatcaaaagagtctggactaaacctcatatagccgctcgcatcataaaatgtaaattccccaaagattatcttaccttcgacattataaagatccactctaacatgtgggaaatctgatgagagatttttcgcaatcttaaccatttcctcaaagttataaggcttttctatattcctagatagaggtttctcatcggctctaatagcatctattctttcaaaatcaatagtataaatacccaaaccacatttatcccccatatctctatccgctatgatatataaatattttacatttccattaaaacaatgaaatttataatccactaatcctcctttttctaaagcagattctatatatttttctacaataaatctagaacccttgattcctgtatacgcccactccctaccaggatgaacacgtattttatttttccatccatccaatttttcaattagtttctcgatatccagattagatttatctttacagataaaaacattttgaccaccaccaccatctgtcgtttttatcacaaatctatttggaagttctttgaaaggaatatctcttgcagaatcataaacaccataacattcattaagcaaatcagaatatccttttgaagatatatatccacgaacatcgtatttatctacacaggtgaacattaatggatttctataataaagcttataccattgaagtttttccgagaatcgacgtggatgtttcagagatagtctgcgtcccatctttatgtaatattgtacacgtaacatgatactgtctggaacccatgagcaacaatttaagatcaaaaacctaagttttcgagatttgactattttcttataatccataaccattaatttttccaacacgaatgagcctcaaacctccatttcttagggaatcttacatcagaaacctttttatcagaaatctctttattattcgaatgaataaacgcattcaacacatatccatattgatccaaaataaagcgaatatgaggaatctcatggcactccaattgcataatctttgataaagtataatcgaaaataaacatatcatcagacatcataatgatccccaaaggcttaggagaaggtccgacaggtccttccttctccccacaaatgatcatatccccaatattaaggatctccctctgaggaagatcacatatattcccttctttattcgcatacctcactatatgatttaaatctacaacagtcctccaaatcgtatcattaccataccaactgcctatacggtatttgtcaccgctaaacaatacaccaaggatatataatgactttttcaagaaatcaagaagtttggccattactattcgacctttaaccgaacaaatagtttgtctgttatcaatatattccatatacatttttaggatacttttcttatcataagcatcccctgttccagattctttatcacctatcgctcgatgaggaagggaagctttctcgtaagtgataccgacaaaatttttcatcgctccggttatacccgcgagtctatgggttttaggttttgggatattgatcaccacatcagctaacaataccgcctcatttatttcatatcgatggattcctttgtcatgatagttttttgttagattataatcatagtcactaactttatatacatattcttttttgtcattttctgcatgtaatgaatttgatcccaagtctacaacctttgacctataaggagaatcaatcaatgtcagttcattacttacccctttatgaaatacacatttatattttctaaaatcacatatatcgacagttattccatttctatttataaaagaaaacaattggttatacccagccagctcaaacatttcatccaaatctgttccctgcattggcgcatcccccaaaattatcttaccctctcccttcaaagcgatcacaacatagtctaaaatcgcacgaactaaggaggggtgtgtaaccaaacatgtcaagctaggatcccccctataaactttatttttatgagatacccaattaggcttcaacaatacggtctgaccaggcttaataacattacctaatgggttccaattacattttccaaaattcgccttatcgtaccccataccatatagcgtattcctcagcatatcatatacgtcattaggtatagacgaaatctcatcttttccccatggatattctggatacaatcgacttggattataaaaatcagttccttttggatagttataaacaccaccgttctctatataaacgcaattcatacttgacactttatattaaattattatcaaatcctcttgtcctccacatccttacgtacctccgagaaaaagtcacgaatccgtttttctaatttggaatgctcataatcaccagccatttgaaaattgcgctcggcagtctgacgatatttagcgttatcacgtaaatgtattaagcaccgtacgatacctttaacatctttctggtccacaacaaactcaggttccaatagctcaggtattcctcccgtattaaagccaatgcaaggcagagccacactcatcgcttccacaaccgagcgaggtaaaccttcttgtaaactaggttgcaaataaatgtcagcatccttaagtattttcatcacctcttttgaagtcttaagtcccaagaatatcacttgatcctctacacccaaacgtttacaaagagtgcggagataatcacccttgcctcctcctatcaaccaataccgataatgaagatcccctaaactcttcagccgggcaatagcacgaatcacaaactcatgtcccttgtagcgcacatccacatgtgccgtggtaatcaaccgaacctcatccgtctccttacggcttgataacttccgcagacggctctccaatgccatagggtcaaacacaccaaaattagtgtccgaacaacccaaagctctaccttctgtcggatacctacgctgcaaaaactcctttgttacataatgtacataatcagaatgccgtacactgtaacgagtagtaagaaaactgattggtgccatcaaacgagctaacagccgatgatgattatggagcgaatcccatggacaagccactaaaaatgaaagaaaaggtatttcatgtcgccgtgcgatcctcatcgcagtatctgcgtcgccagatggcatatagcctaccaccagatccatgaaaggaactaaacgctccagcaatttttggttgtaaacactattcttcaaccatcctccaacacttttatttataggccgcaagtattccacatgtcccggatctacgaagtcaatcttttgattcagatatatagtactagccatctcatccgaatatgaaaaagatgccgcaagacgtaattctcccaacacactcatattttcaagcgtcccatacaaggggaaatcacagtaacacccgtccttccggatatctatatattgattggttacaagtaaaactttcattgatatttgatattataaaaaataattaaataattcgtaagatacaatatccaccaaattaacattcagacaaaaaattcatcttccttggcacaagtatcttaaaacatataaaaaaaacactctcaaaataagacctgtagatatcattatattcccaggcaacgaatacattaatggcatcattactaatgcatgaaaaaacacagatagaaaccaataattaagtggattatacacattcaaatatccatatttcatacacatccaaaataatgtataaactattcctagtaaaaacatgacaaagaacatcccatacaaagaaaagtcctctatcatatatttgaaaccactgtaaatattcgatgtaccaactggatatctaaaaaactcatcatgatatgaatctaaagagatattaaagccaaatctattcaaaaaatcatataaagtacgaaacgtatattcgcaccaactattctctgtcatcatacccaatggcctggatagatactctgtcaaaaaaagatctagcccaatgatactcgaacctgtataagaacaaacaaccgagaccaaatccatctcttcttctccagatctaacatagcccaacccaagaaacaaaaagattactaaaagaatatatttcactactctatataagtaaggaaccaaaccttttattttttcacatcttactacctccgtttgctttatcatcataaacacaatagaagcaacgcaagtagctatttgtaaataagccgatcttcctccagactgaaatagataaatcggacatcctatcaaaaaaggcaaaagcaatttaccttttacaactcctttaaaaaaacgattataacaatacacataaagagaataaaaaataagagtatatgaaatattttccaataagatcaagccaacatttttagcaacaatattatccattttttgattagaaacatctacataataacttctcaccgcaccataggctagaaccggatcatctacaccaaacaaagatgatatactcatgaagtgtttatagctgaaatatagagtgactacaataaatacacacatcaggaaaatatacttatctcgtataagaatacgttgtctatctctaaaagccactctttttcgaccacgaaaatattgacgcaccagtatttctccaatattgaaagccaaaatacccactaaaatcacggcaaccgtatgtccatgaatatctccacccaactctttttcgaacatatatgcgataaaaacgaccacaaagaacgaaaaggacaaaagaaacgtaggagatattatatctcgccttgaaaaaaagtaagatataattatcaataaaaacagtaaagcagataatagcaacaacatataaaagcttgtttatttctgacccaactaaaaaacatcacttttctatcaacttaatatattgatttttaaaatattttaaatcaaataaagactctgcaatctctcgacttcgctcccccattctcttcttttttgacttcggtaaatctaagaatctcacgatacttcgtgttatatcatctacatcatatggattaaataatataccgttttctccatccttaaccattatagagttatcgcttacatcgcttacaagcatcggcttaccacaacaaatagcctcagatatcgaattagagaatccctcaaaaagggaaggctgacatattacatcctgctctctcagtataggtacaatctccctaacttgatcattcaagtaaacaacatcgcttaagccctcctttaggattatatcttcgcacataagataatacggttcaaattcacctgatccattctttttcctaccataccaattcaccacaaatcgcttgtccgttagctcacgcacacatttgatggctttagcaaatcgttcgaaatttttctgcttatgataccgggcaaaaactcctatatttatcatactatcatcatacgtttcatcctttgttggtgtaaaaactttcagatccgtataattggttatagttataattttattttttaaatccggccttttagctattatatacctagcttgagaataactattcggtacaataaaagaagcacgcacatataacctactaaaaagcatattctcatatcttccgggcttatccgttgtcaaatttctctcactggctatcacccttatgcttttccgaaaccaaagagaaagcaatcccaaaaaacttgaacgttgtccgtatgtaattacaacatctgtattaaccttattaaaatatataatagttcgcaggaacctacaaatcatgcatctactccttctatatcctaagcgtatcctttttatagaaggatttaaataatagtgatcatttatatcacaaaaagtcacaatggtaatttcataatcgttcactagctcattggctagagtcgctaactgacgctcagccccaccaccactcattgagtctatcaaaaaagttattctcttcattacaaatagttatatgtctaatattcgtcggcaataattcaatggcgaatgtgtttctatgtcaactgacattttttgaacaagcctgtctctcaacgactcatcttctaactttttaatcgcttttaccgcatctgagactccccacattggcacaagtatgccattttgattattaacgatataatttcttgtacaagaggtatctgttacgataataggtcttctcagtaaggctgctttagtcagcacgatcaagccattagcctcgtcacgctccaacggaagatataaaatagctgacttgaacagactcgtgtaaaaaaaatcttttgaggtatcaaaaaaaactttcacgttatcaggtatctcccattcttccctccatatcttttttgccgcaattacagtaaaactataatcaggtaactgcttagccacaagaagcagcgttttgaaatcacgcgagcatcctccgcaaaaaacggatcgctgctctactcgtattcgcaccaactcttcctgagtaggcaaaccattccattcataagaatcaggcaacacaacaatcttccgaagtggcatatgatatttcgctccataccttgtacgctccatctccgaattgaccgctatacagtagccaaagtgaaagcgagcgaaaaggaacattacttgccaaaaatatcttttcaccaacaaagtatctataagaatcagatgcaatgcgatgattttcgcctgacaacgccggaatgtcagaaaatctctcaacagaaaaaagaatgaagattcccaattccagaaaatcacacgagactctcctgcatatcgcttatgcgctttccagcccagcataaaacgggcaaaagaatttatagcctgtccccatacacctcgtttcttgaacaaatctgaggaggttgcatgctcattgaccaaaatttccacctcataccccaacctgcgatattcctctatcatccaaaaatcaggtttcgacgtaaaagacaatatcaatagaatttttttatttgtaaacatcataattttttaatttattcttaattctatacataaaatccacgatccgcctgctaaagggaaaacgaaacgtgtagaaaaatgccccccgccaccagtcaattcgatactgcccaaaatctctccaagtgattttcttaatgatataccggttgttgttattcatacacccgactcgtctcccaaccaatgctttcagataatgagccgatggcgaaccagcaaatttccctaatacatccaaggatctaagtaatacagattctatttgcttatacaagtaattattcatgaataaatccgcatatatcatcatcaccaactcgtgtttacgaacgagctccaacgtctctgcaggcacaacctctcgagtaaacattggccgtacctttccttccttccacatatagcagatagtacgagcggtgggagctgccgaaaaatattgctcaaatacatttctcaactctactatatacttcaatctttgactttttagcatccgctctttataaagtaaagcttggtaactccctgcctctgtgatatttttccggtcatctgccacctctagataatatccaaaagtcggtggataacctgcatcttgtaaaatcgtattgatcacttgatggcaatggcgggtaccccgcacatcaacaatagctgttgaagcattctcgtcggccagccctttctctccaaaataggccaagatcaatgctcgttgctcatcatgatatgtttgaagaatctttattgcctcctcggaatggagtaaaacttcaaaagcttccctagcccggccacactgtccaaccataggcaacgtatcgaccaaccggtcacacacatcatcgcaaataaactcagataacacatcacgcagactacttgtcaccgcaatcatctgataatatgtttgaaaaaaacattcaagattatccgttgttacctcccgaattcccgggaaataaagggaagctcgagaaacatataaatagtctagttccaatttaggaaattgtttcgacaacctctttgctattacatggaggatatagccatcccgcgccaaaaaaaatattctgttaatccctcttttactggcgtctgataaaatactgaaaacaaaagggacataaagtggagctatcaaatctgacgcaaaatcattcacgacatcgtcttgtaatgatagccgaacagccttagaaatcgcagccatgtgctgactgacaaacaaaccgggaaaaatatcaggtcgcaataaacagcactcatatacagagaatttatgctttatcaattccaccctaattccccactgctgaggcattttataatcactatgcctattatcaccacaatgataccatcgagagaaagtaagctgattctcgtccgctatcaatttataaagatttcccgatcgtttagtaaccccataggtagaagacacatagagccgatcgccttctttccaaaaaccatgtgtcaccaacaaatctttcaagaaagaagcaggaaggtacatgtctgagatataataaatattctctcctctatcatgtaaataatttatccgttcccatatcgaacgaacagagcacaattgttctcgctctacttccatttcaatctccgctattgcctcattcgataaagatgttaagcctttaaacgaacaatattgatagatatccatcaaagagacctcctctttatcagacaagttccgagcagtttgttctcccttcactcgtatcaaagcaaaatcggcaagcatactttcgtcgcaattctctcctaaagtacgataagccaacaagtcgaacacattttttggaaaaccacatgctctaacaaaacatgtatcaaataaatcaaatgaataagttactgaattcatctttcaaaaatataatcggtcgagcaaaaaatccaaatatcactttcaagctgtaattatcaaaagatttaaatgcaatctgtatcaaattatcacctatccctactaattcctaattaagacaaagcaaatagattttacatcataaaattgaatttcaaacagatatattctcaaccgttacaaattttttgtaataaaacgccatacatataaaataaataattgagcttactacgcaagtcagtaatgctccattcatatcccataaatacaccaagagactaaatccaaaaatcttaaacgtaccacaaacaaaactagcattttttataaatttaccttctccatgagatcctagatatctgttcaacatatcaccaaccccatgtacacaatatcctatcgcaagccacgaagcataaacaccaacttgagaatagctatcagagtataagaatttgacaataggatgaatcaaaaggataaacgctatacaactcagaatggtcattaataaagtcatcttcaatactttatctggaatcctagattgatgagcaaactctttaaaatacgtcgttcctataattgcaggaagcatagacaaaggacctgttactgttaatgctaacgtgtaaaaaccaacattggtgttgtcttcgttgaacattcccaaagtaatgccagcgatatagtttgttgccaccatcaccagcgagccataatatagctggattccataatttttattctcttcgtgcagttgtacaaatgttgaccttaaacctttaaaagagggtttagtactaatgatgacaattacagcgacaagcgaattaattccccattgtaataatatcatttttgtggacgtagctccataggatgagtaaatgataaaacctaaaggaacatataagagtacaggaagcaatgtgtttattgatatgcgcactatatgattatccccttgtgccgtagtgtttatataatcattaaaaagaggatatagacaaaccggcaatgaaacaagaaacaaatatgctagccgtggatgagtaatatgaaagaaataattacaacctgttgctatcaaaagtataatacttgcaaaaataaggattattaccatacatcctcttatcttcttactatttttctcctcacatgacaaagccagtagcctactacctgacctagaatatccaaataacaacaatgatgctatcaagttgataatgttctgtacgtatctcacatccccataatctattgggtcaaggaatcttgtattaataacagaagacaagactcctagcaatgtgcctaataatgtggatgcatacaagataacgacttgcttgttttgcttcgaaagagtatgatagctaaacattatatcagctttttaaatcggtacttaaagtatgcgacttgccctacgaaatgtgcctctctcaatcctttccatcatttttgtgggaacactcgctactatactatcgcctagaatatcatgagtagtaactgcattagaagctacaagaacagatcaccgacaattggtgcctgttgataggatagcatgatgcatcaccgatatttacattttcactttccgttccctatttcgcttaatcaaccaattcaagccaaaaggcagtaaacactcaacaagtttatcactaattgaaaatcaatcacataacaattgagcgggtttatttttcatgtttaatttgatcgtttgaagggcttttacccagaaatagactttcatagtccttattcccttccagtaactgatgaaaagcatgcgagagataatccattggagacaaattattcagtttagccatttctatcagagtgtaataagtcgtagcgaccatcatgtcgatagttgagtaatttccccccatccattgatcatatagttcaacgcagtgttcatcatttcacctaaatggattcttttgtcttttagcatccggcatgccctacctagtatcttgtttatctcggtgacatctgcatgattgcgtctttctcttatttgttcatttgaatttggctcttacgtgacaccaacatagacaatctctccaccaaggagcggtcccccggtagtctatcacggataggctgtcccgatcaacaatctctaccggtacttgcacccggtcttgtttataccaacgttcaatatgagaataaacgatgccattcatcttatttttgacaatgactaatagctattgagtgcttacgaatggctctacctacggtctaagcggacagatgtgaaaaacgcttccaatcacgatctcaaagcagtgataagataatcaaaatctggaaatgtaacttttagcgtttgcgtatcaagcttgggaaacaccttgacaaaatctcttactttgtggtattcttttccattttcattataaatccgagacaatagatcgctcggaaatcaaagctcctcgtttaaggttgcaaaaaacggccaacaaacagagatagcgcaacgttccatcacttatgttggagacatgaaggaacgctcaagcccagtcccatcaagcagcaattctaagttattgcctattacattaaagtcgaatcctttcaccatcggattgatcggcacaaacgaactcattgcctatccctcagctcgtttaataaatcatttaaaatataatcgtcactcatcaaatgaagtccatacttgctatcatgcaacatagaacaagtacgcgtatcatagaagatggcaagcgcacgctccggggatatttgcaaacgctccgctagtcgcataataatccgggcgacctttctccaaagcacttgctctctcataccggcctcccttctcgtatatcattaagccgctcgctatcaacaaaacgtaaatacttatcgagcaacgactgactcaatatacatatttgattattaggtgaggtatatcgcaatttacccaatgcttgatcaaccgtgatgatacagaacaatcataactcacctcctctctcacctccggatgcggcggcttcccagtttcgcaagacctccacgacatcctccgctacatgcctcagactttgggtgtgcatgacatcataacaatccaacagcaggcgacgcaccaatccgaccttttccaaacgtctacgcatttccatcggagagatactcatttccttggcagaagcttctatggccatcaccgcaaaatggatcttatctcctatttccgcttgtcgagtatccatgagtcttatatttatccttctttgtggcaaagataatgacatttacgattcctccacactgatcccaataataattcttcacctatcgcggttgttcgctctctttctgttcccgattacgcctaatcagcccattcaagcctacatgcaatatactccagcaaaagagattcaagaaaaacaaataggttatatccacacgccatgccaacgagctattaagcaggataaagaaagcggaaatcgcaatgatacaaaccatcaccatccgcacccgcatccccgtgcgcaacaacttatgatgaaaatgattcttatccggcaagaacgggttcttgtgctcacgcaggcgatgcaagaccacacggatcacgtccaacagcggaaccagcaccgtagagaaagcgatcaccatgtacgggttggacaatgtcggagagacctcgttcgtcacgctcatgtggatgatcaggaaactgatcacgtagcccagcgtaaggctgccggcatcccccatgaaaagcttatgcccacggttggcgttgccgaacacgttgtagcaccaaaagggcataaggatacccagcgtacagatcgccaacaaggcgtaaacatactgtccacgaagaaagaatataacgctcaagaccgacaaggcgatacaacacagacccgaggccaagccgtcgataccatcaatcaagttaatggcatttgttatatataccacgataaacaccgtgaacggcacccctacccaaaccggcaccgagtaaataccgaacaagccaccaaacgagtcgaaccagttgcctgacagtaccaacagaaacgcagcggcgatctgcacggcgaacttatagcggtagcctacaccgaccagatcgtcgcaaacacccaccagataaagtagcgtcatgcccacgaacaggaacaggtactcataaagcatattgaatgacaagctcgaggtatccatatcccaaaagtacagacgaaaaccgatcaccaagaacatcgacatcaggatcaccggaaaaaaggacagcccacccagacgaggaaccggcatcgtatgcaccttacgggcgtccgggacatcatagagccgtttcttatgggaaatcaccaagatcctcgggatgatcaccatgccgagcgatacggcaaacaggaaaccgaataatagaaacaaagatgtttgcatgatcctaacgtataagattaattctttccttcatccatcttcccccgcatgtaagcgatataccgctccacggcttcatgggccagccggcggaaccgatcctcgtcatccagatgttcccaaaggagatccaacagacggacatagatgctgaaatgcatgtctataccttttttaaagcgttataggtactgccgcccatacctccggttacgcagacgatggatttggtcagcttggtgactttcagcagcgtgtcgatgtaatcacccagacggggaaagaattgttgtcggtacatatgtgataatcgtattaatttctctgaaatccgtacgtgtggggatacggcagtcccgatacctcccggtcgtgccacgaccggtaatcttccgcagggaaaacggggacggtcaatcgcttataatccggctcgtctatccgcaagatatgcttgcgggcgtacgaacgcagcgagcgatccgttacggacaccatcacgaccggaaacggatacccgaacaggcgcatcggcgtggtctcgctgtccgggaacgcacgacgcaactgataggccgaacgctcgaaggcaacccagtaaggccccgtacaatataggtgcatggaggtatggttcgcacgctcacgttccatgatctcgcacaaatggtcgttcagcaacgccaccaaacgaacgccggaaggaagggtagacatcaaatttgaattatgaattttggattatgatttaaactgtcaactgccacttctcaactgtcaactgattcgtggcccagccatctatcatagtcgcccagccggcggatcaaggataatttgcttttcttaggcgagggatcgacttgccaaggatccactagctcgtgtgccatgcgacggtagagagcgttatccgtacagccgtacaaggtgaccagcaacagggcacgggattgcggtgctttcacgacaggcaataagccgcgcatcgtgtcgtgcaagcgaacgaaagcctcctcatcgcccgacagcttataggtcgggaggagcaacgcgcacagcttgcagcgcatcacgtctgtctccgcacgcaaagaggcatatccccgcagtacctcgccggccaatcgtcgatcctcctcgcagacactgccggaagcatggtaacgtcccaaggcctcgtgcaggccctccgacaggcggtcgttgtccagatgggtataaacgtgcttgctcttcgcgttcaactcgatcaactcgtactcacccgcctttacctcgaacaagggtacccacatgcaatccagtatgcgtgccatcacctccttatgaccgccgcccggctggatcaccacctcggcctccatcccggtaaaataaccggacgtgatgcgtacccgatcccccttcaacaagcgggtactctccggcacgtacaccgggagctcgttggagtaagcctccgccacccagcgcaaattcgccatctcctgatccaagaggtgcgggaaataggtcgtactcccggaagagacacggggaaggaaattatacaaggggagtgcctgcttcatacggaagatttcctctaccgaagaacggataaacacgtagttgaacagcaaaggtcgcctcgtgttgaccagcttgccacccacctttcgtacctccacgtacgagggggcgaaatactcgaaaagagtctctccccggcgttcccgccgggaaagctccacgtccaaacctttggaggggctgatccggtcacgccgtccacccgcagcggtaggaagcgtgagcacgtaccagcgcacggctttcaagtcatgacgcttgccggcctgtgtcaggccccccttcggacgatcgtttctcaaaatacgcgtcggcatgattctcttttccctaagatatacgaggagttcccctctgattaaacgacaattcaaagccctgccaagcgtaccctatttacgcctaacacacagcactttaagttttcaaatatggcatttctgaaaattaccatacctagtgaatatttagctactcgggaagtagcgtaaaaggaggtgaaaattacccagttgtagagacggagcatgctccgtctcccatcgtctgacggtaatttaaataccattttgaggagatgagacgaggtacgccccgtctctacaggaatacacacacaggttatgaggcatggtggaatgataccgggaacaagaggtcgtttcacccgcatcaccatgtctatacgtttaggataaaatgggaaaatcaaagaatagagaggatcaaacgcctacaatgagtaaacaagcggatctattcgcttgtttttagttattttttactatattcgcggcatgaaagaatacgctacttcccgagtagctaatctcttaccccacctcggataccggtttatacacgctctcgaagcaagcccggttcaccgccgacagacgttccaaggaaaagctcttcaagtaaatttgcgtggtcttgatagacgtatgccccaacagctcactgatcatctcgatcggtacgtcctgttctttcaaggtcgtggcgaaagagtgacggatcgtgtacgaggtgaccggctcacccacaccacaagtctccgccagcgacctcaagtcgcggttaaagcgcagcaaggcgccgttgtattccgcataggccgcctcacccgttttcttcccgctcagaaacgggaacaggtaaggcgagtccttgtccgtgcaaaccgccaactcatccaacaagagccgtacatcggccgggatctccacccggatgaaagacccgctcttctgacggtggtacgacaagaccccgtccttgacattctctttccgcaaatgggcgaaatccacgaacgccatcccgctgaacgagaacatcaggcaaaaacacagctgggttctccgcatctccggctcaactctcggagtccccatcaacgagcgcaagcaatccaaaggcaacgccttcttccgcttgctctccacgcctgtaaatacccccttgaacagattcgggatatacgaaacctcgccagcctccaccgccaagttatagatatgccggattcgccgcatataggtggacaccgtattgcgcatacagccccgcttcgacagccatgcctgataaagcaagagcctctctttgtctatataggcataagggatttcctccatcccgcaaaaacacttgaacgagcgtaaagcgtccagataactcttcgccgtggaataacgccccacctcacgaaggtgggctatataagccaacatacccgccaccacgtcttcttttttcatataaatcctccttaaatccttgtttattctgttatcttttatttaatcatgtcaacaccattaacattgggacgaactgttcgtcccgcactttattttattaatccgaccttcaccgccgttaatctaagaaaaagaatacatgaaaaatgaatttaaaatgtcccttttcgcagccccgatctcaccggtcaaagatagcctaacgggacgagtatcacgaccggctaccgtatatcccagtcgagaagtcaccttacaggaggtggcccgactcatcaccggcgatccggccctcgaacgcctcacccggcagctccgcctcccgcttgagacgggtgacaaggaacgattcagcgagctgaaacggcaaacgctaccgtatgtcacgccttgcgggactttctcctaccggaaaagcgatcggctcctagccccgagcggattggtagtagtggatgtagacggattggactctaccgcggaggcggaagctctccgaagacagctgttcgacgatgcctacctatgccccgctctctgcttcatcagcccgagcgaacgaggcgtaaaggctttcgtcccctatccggaacatcccggaaacgagacacccgcctatatctccgagcatatcctaggcgtaatgaactacgtggaatatgtgtatggcgacggagagacgcgaggctcccagaaagtagacccgagcggcaaagacatcgtccgctcctgtttcctatgtcatgatcccaacgcactcttcaggatttgaaatcataactcataaatcataaattacatgtcagacagtttatcccgcttagtagaagcggttcgttcggcgggtgtagatatcgcccccggatattgtgaatacgtacgcttggcgtttgccatcgccaacgattgcggcgaggcaggacgagaaggtttcatcgccctgtgttccctatcggtgaagtttaaccgggagaaggccgaacgacttttctccaactccttgaaaaagggagaccacaggatacacctcggtacggccttccacttggccgaactggcgggcgtacgcttggagcctccaagccgcccccgcgatacgcacgcaagtaatgcaagtaatgcaaataatgcagcacctgtttcccacacacgtgcgtgcgataataatgtagagaccgagatcgaggagcaggtcgatccgttcacccacctgcccttcttccccgaggggcatgagtggccccggatgttgcggcagatcatggcgttcggacagagccgggagcaacgggatgtactccttctgggcgggctcaccaccttgggtgcctcgctcgcccagacgctgcggttcctatatggaggcaaatggttcttctccagtttgcaaaccttcgtcgtcgctcctcccgcctccggaaaaggcgtgctcgcgtggacgcgaatgctcgtgcaaccgatccacgacgagatccgggcgaccgtggcggaggagatgaaaaggtataagaaagagatgacctccttcaattccttgggacgggaaaaggcgaaagccgaggagccggaaatgcctctcaaccgtatgtttatattctccggcaacaacaccggtaccggtatcttgcagaatatcatcgactcgggcggcgtggggatcatctgcgagaccgaggcggacatgatcagcaactccatcgcctcggattatggccattggagcgaggtgatccgctgctcgttcgatcacgacccactcagttacaaccggcggacagaccgggagtatcgggagctgcggcactcacacctgtcggtattgataagcggaacgcccgggcaggtgaagccgctgatcccttccagcgagaacggattgttctcccggcaaatgttctattatatgccccgtgtacttcactggatcaaccagttcagcctacagcggactgacacgtcgctggagttccagaatttgggcaaggactggatcgctcacttgagagagatccagaaactgggggtgatctcgcttcgcttgaccgacgcgcaaatcgtctccttcaacgaggtgttccaaaccttgttcgagcgctcccggaagggcaccggcaacgagatgaacagctccgtcgtacggatggccatcaatatcggacgtatcctgtcgatcgtcgccctattgcgaataacaggggaatgcgaggaggcgggagacttcgccgccagcctgcgcaagtcgccccggctcacgccagactcgcagatctgcgccgacaatatcaaggacgggatcatcacccgctgggatctctccatccaagaggatgatttccaagcggtcctttccttggccgagcctatgtacctacacgccgtacacatactctcgttccttcccgccaacgaggtgaagaaccggggcatggccgaccaagaacgtctcttcatcaccttggatacgggtttcacctatcaatccctcttggaagaagccgagaagctgaagatacccaaaaacaccgcatgcagttgcttgcaacgttggcagaaacagggaatcgtccgaaagggagaaaaacgaggggattataagaaaacataatccctcttcctcctcttcttttaagtatgtacgcacgtgtgtgggaaaacaggtactgcattacttgcattatttgcattactcgcataagtcgcacgccccacacgtacaccggcatcgcctcacgcctacgcccgtacagggccacgccgatatacgtgtgggttaacgtcaatatacgcatgaagcgatgccgatatacgcacgcgaaagcgaacgtggaagatactcgttcaaggacggcccaaatagcgaaagatcagttccacttgcagggaggtgaaaatccgctgccggttttggtaacccgtctcatccagctcatggctgagtttctgatgatgtcggacccatcccgccaagcggttgagggcggaacacggactgatatcgggagcataggccatggccaactcccgtttgctataagggcgcaccggccactcatccagatattcgttgtttgtctgcataaaataggtatttttcattcatttacaggaataaagatactgaaaaagtacgaatccggcaacgatccgatccactaatattcatcttttatcaccttatataccccgatttcacaccgcctctacgagactcattccggaggaaaccggaagtcgtacattcgtaatcgaaaacagatcgatcccattttcaattatcaattatcaatttttaattattaaaactatggcattaaattacagtgtggcccttcggcccaaccctttgaagaaagacgagccggcgaaagcgtacgccacggcacaggtcaatggagagctgtcgctcaagcaactgagccgccgggtatccatgcaaaccaccgtcagccgtgcggacgtggtagcggtattgatctccaccgtcgagaacctgcttgatgccctccaagagggaaagcaggtggatttcggcgagttaggcaaattccgtctacagatactcaacgagggggcggagagtcttgagaaattcacatctacaaacatcaccggtgtcaacatccagtatataccgggtgaggacctgaagaacatcttcgccggactggagttccagccggtggccagtcgcaaggctcagcaagccgtgcttcgtgcggagaaggctggggagacctctgtcgatatcagcaagaagcccgcttccggaggggacgactcggaatcgcctgacgagatctagcgtgtcacttttggcttgcacccaatcggtatgtcacttttggcttgacccaaaagtaaccaaaaggtcaaggctgacgctgacggctgaaccgctctctgtccaagggaggatatcggcgttcactgtaatcgcccggttggataaggttatttgtattttgtgggtatgtcctcttttccaagtgatctgacttaagttggcggataacgtccggtcatccgtagtgtcatcccgcttgccgaccactaccgtaagggtcatgtcaaccgatgccaaaggagccaccaacccatagcctacctccaccggaacacccgcggcaccgcaaagtatggcagtggtattactcgacacatcgtttttaggggtaaaagtgagttcggctacctttgttcctccaccaagcgctccatccgcgatccgcatcgttcccgtgccggtaatgaacgcattggaggatgttttcaacgttatcttcttcacgtaatcataggtcgcattcacggaacgtcccgtggcggattgcatcgtgaaggaaaggcgggccagcgcatgttgcaagtagatttccggctgataagtaccgcttgagggggaaccgccggacggcgtggtattgctggccgtaatagcgatagcctctcctaccgtgttgctggcggaaccgtacatataatcggtagcgtcagaatcccatcccttgccgccatagaaattctggtgaacgggaagggtggtcgctatagtatgcgtcgtggtagtcgttgattttgtcaagatggcgttcgccgggctataggcatagatccgggcctttacactcgataaattcacagtgggatcgcctacccaatcgtttccgccgctacctaccgactgataggtgaaggtggaaaggccagcatttcccgccgtaccaaccccgccatagggagtatagccgtcctctgctttagtaacgaaaagttttaccgcgttaatccttccctcaccctccgtcgtggaggttccgcttatgatggagcgggtctcgacaccgctcatgtggaatacgggttgtaagaatgcccctgtcgtgtcttccggcaaggagtcgtcggaggagcagccggataagagcgccagtatcgccaacaggcctacaccgaggtgtagcggacgtgcgtttttgtaaatatcctgtatcataggtcgtatagtttttttagatagtcgtacttgtattgtcggatgattcattcgtccaccctaccacattgaagccgtccagcttaaggccggtaccgtggatggagatggtgtatgtatatttatttccggcggaccattcgccaccgtcggtaatggtgtctagtttcatttccttgccatctactacgacggtcaaggtagcggcggtaacatttgcagtgccggaggggaatggtacgccgtaattgatgaactcgattccgtctgtggtagcggcaacggttacgccgccatttaccgtgtactcgtactttaccggtgtacccgccttcgctccggttaggttgccgagggctccgtcctttaggctcatggtggtggtaccattcgtttgtagtgtcgggatggggcgactataggttatttttgtcaggttgcaaggaccgacgtagtccgtgtgtttcttgaactttaggcttaccaagcaaaaggcatgcttaaggcctaggtttatcttctcgccttttgaatcggaggctctgtggccgttatcggctatgggttgagttgttccaaaggtattcgtggaagtgttataggctacaccatacatataatcgttaccgggaactgtgaaatccaaggaggaggcattcgttaccgtattcgaatagactatggcattagcccgtaccgggatggtatagaccggggaagaggcatttccggccgcggttatcgtggtggcatccgtgactggatagcaagagtagactatggcttgctgggtgcttagccagatcgtttgatccttaccgtttatcgtagcgggttttaaggaaccctcttggagggtgtattgaccgtatgtaccttggggggatgtgccgtaatggttttcactggtctcgttatttacggcatataagccgatggcctttatatcgccggatgtggcagtggccttggtaagggctacgctggcgatctgcggggacagggcgacaggggtatccggatcaaccgggggtacgatggggtcttcgccatcctcgccgccgcaggcgaaaagggaaagcgatactgttgttaataataggtatctatacggtttcatatttatcgttgtttatattgttcgtttatttgccacccggttttattattaccacccggtctgattgttactacacagatttcgtgttttgtatttcgtgtttcgtgttttgttgtagagacggggcgtgccccgtctctacaaccctagactgtaagttaattaactttcaaatcatcattgccggttacggtgccccaagcggctacggttacggtgcctatggataattccttaccgctaagttttacggtatagatgttttctttcccctgctcccaagtaactcctgtcgcattatcagctaacgctacctcataatccgctccatcaatcgtaaagatggctttggtattatttagggcttggttagttatcggcaaagccaagatgctgaatcggtatgaagcccctttagctgcattatcgtctgataaaccagagtctcctttctttttcaaggtataagtagcgccagtagcaaactcacggatataagatcccgttgtcaaggaactattattagccaaggttcccttatcaatattcatcgtagcaagaggattgctattaccgcttaccttttgattaggtacatccttcaactgtatcttcgatagcacacctttattcttataagttccatcattgtaaatgcggaaactaaccaaagtcaaggcatgcttcatggttagatcaacagaggcatctatagaggtttcctttttcgtgttgctcgcagttatccaattcgtctcagagctaccttggtccgcccacatataatcgatttcacctttcgctgaattaatctttgccttattggtatttgtcgtttcagagttgtctattaatgtcgagggataatccctatgcgcatcatcagtcgttccagcaaagaccgttactgggattgtggagttatccgtagcggtattatcagataatactagagctgtggttgtggctaactcttgatttgttccgggctgataagccggataataagcgtatatctttgccacttcggaggtcagatatattttcttattctctccacttttccagcctgcggttcctgttgtcgaataagtatataatgcgtaattattgcttttcgcattcgtataaggatcttcacccgatacgactgtcccctttaagcgtgcgtacaccgccacgcttttcatgacatcatctttgctagcgttagcttgggtacccgaatttatcacgcttttcgtaagcgtcacccccgccgtaatccccagctctacggcatccggctggttggaagggaggatggaggggatattgtcctcgttgctacaggcagccaagaagaagggagaaagaaagagtagtttatagtttatcagttttctcatgattactttttttgattcgttctattaattgttcaattcgtttagtcagtcagtggatcaagtctaggttgccatcgacatacgagggagtccattcggctacctccacggaggagatacctaaagaggcatcgtagatatccaacgtgatcacgtgagagaaaccgggcttgaaattatcctcagatatttcatcacccatctttacggatacgtcggtaaaggtaccgatcgaagtctcgaccgttatttttacattgcccggatcgggtgtaggcggcagatacaagcagcccagatcgatgggaccgacatttgatgcccctaccgtggcgttgccggcaggctcaaggatcacttccgaggaaccggagaagacagcctcgcccgtagccagcggaacatttaccgccgtaggtatgcttttcacgataatcttgttcaccttcacctccagtcctccggcatcatgcttctttgccttgaataccagctgggtaagcaggtgggcgtaattcaatgagcgattcgcctcgaccccggcgacggtattgcccgtaaaccggttaccatcccacttattacccgccaagggaccggcgtacatcaagtccatatgcccgtcaagggtatagcttacggtaccctcggcggcatcgtacgagttatcgcccgccacgggagatacgccgaccagatacacgttcgctcccatgcggggataatggtgcttacgagaggcatcccatgagatactcccgcctaccgccacatcagccgtccgctctacccattcctcgtagaatacggcgtcggcccaactcgtggtcacgtcggatacgggggtggagaaacgatcggcaagactcgtatagtcgggaacacctgtgatggcgtcgagacgggtcacgcaaaagagggtggtcttgaacgcctccgcctctccaacttccgctttcgtgcttatggacgtgtccgggtacgtcgcccgaagctcgatcggaggatcggcggaaggtatctcacctcccgcctcaccattgtccgagcaagcggccaacgatcccatgactatcatcgacaatatgtatgtagagagttgtctcatgatggttgagggatatttaggattatttcaagtcaacggttccgccgttaccctgtttccattcgttaacagtggctttcacttccagtgccttcacattttctcctgtaggtttatctggctcggtaatgttcaacgtaaccgtatgggcatagccttcttgggcattcaacttttcacctgcattctttgagtccatcaccgggacattcaagaaggtacgatccgtaccgcctacgttgatcgttacgttcagcttgatatcattagacggagcgagcatcactgccgggctaatcgtagaagctgtcgtggaaagagcggttgtcgtgatattcgggacagagaaatcggaagcagtagcccaattcacgtcaccatttgtcaagtttacggattggggcaattgcgtgcccaaaatcttgatgctcttgatggagacgttctttccttcccattctcccttaccaccagctacgcttgtgtaactagcggcgaaaaccaattgggtggtcttgtgggaaaacgtcaacttacatccctcctgacttggtaacgctgctgttccggcatcttgatccgtaccgatcgtcatgacatcctgcaatccgtctaccttgccgaaaaccacttttgaggactcgattgttccggaaggaacgaccgccgtaatatgggagtttttgggactcacttccgtattatcataatacaaggtgggagtcaaggtaatatccgtctctttcccagccgtaaatacagcgccggctacgttggcacgtgtttccaatgcctttgtagtttcattgatcacattcttgtaaaccggattaaagctaccccaatcatgctcgtgtccggaagtcacgtccaccatcaccacgataccttccacctacgatccattcgtgatcggggctttagtcgtgagaccttccacgctttgtgttaatttgatcgctaccggagcgttcgccgtacccaaatcgggagtgatcacatccttgtcgttcgagcagcttgccgctaacagggccacagccgccattgtcaaaatctttttcatttgtcttgtaattttaaagtattaataaaaaatatgaattaaataatctggtctataaatcggcgttgccgccattgcccggtttccacggggtgacggttgccgttatctttacttggtactcctcgaagggatccggctccttgggttcctcgggagtatcgggatcgtccggttcctccggatcaacgggtatctcaagcgagatctcgatatcgtaagcccctccactctcgttgccctcgccgccgaacgagacggggagatccttgaaatcctgcccggaggcgggatcaccttccagcgcgagcgtcatgtcaagcgtcaaggaggccttgggctgcaccagcacgaatccggggagcgtcactacgccatccaccacggggataccattcccgtcatcggaagaatagatgatcaccgagctggtctccccgaccgggaccacctctccatccgacaaggacaccttagctaccgaggctagcccgttcagcttgacggcatgtacgctatacccgtccggcgctcccttgacacgtaggcggaagctgagttgcgtcagcaggtgcttatggatcaagggcgtttccgtagcgtcgaaacggcgggacagggagccgctccgctcatcggtcagcatcaagtcttcctgccccgtcagctcgtaccgtacctcgccgttcacgtggggggcggcggggtgatagctgcggatgaaaagcgcggagccgtccgtgggatagtagcgctccgggtccaagaggatatcgccctccgtggccgtccccgtccaatgctccgtgtaatcgccggcggaagtgcctacggcgatggatacgggcgtggagtcgaaaacgtccacggcggcacgggtctggatgccggtgtaaaggcggatcgggacggcggggcttaccttcaaggagagatccagcgtatcacggcccgaggacatggcctcatgcaggctcgcggtcaggttctccttgtagctgaaacgctcgccgccggcggtctcgaacgagagcgtgcagacgttgctccggtccgagccgtccagcgtcaccgtacccaagatacccgccacggcttggtaaacgcccgccacgcccgcagccgaggcacggaaatcaaggtcgagcacacccactcctgtcgctatccggtcggacaggcgcaccgacgaggctatcccgtccaaacggccctccaccttcgccccgccgaagcctttccccgcgtcgatggtaaggcgcaagatccggcggatatccttgggggtcgatgagatcgcggtctcatcgccatcggtcaccttaatccccgtcacgctctccacgtaaagagggctatccagcgataccagcaggctgtcgcttcccgagggaagggcggcggcataggctttccccagattctccgtatcgcccaaccggacctcggcggggtcggcgccggcgaccagcagggcgtactcccccaccacgagccgctcgctccacgaccacgtagacggcgttccggcgggctcttccttccccgccacgcgggaaccatccgccttataagcgaaaacggccaagggagtatcgcccgtatgtcgcacggatacccgcaacaatccctcgccggagccgggaacgggtggttccggatcgtccttaccgcaagctcccaagacgaggaagccgagtaataaaaaagctgttttttccgataaatgtcttaatctcatatactagtttatctatagtttttcctttccctctgtacgggccggttccctgccgtcggggagggtgtctccctagcgttagggatgacgcctccccagcgttagggacgatgcctccctagtgttagggatgatgtctcccctgtgctagggatgatgcctcccccggatcaaatctcatccgggctctcggagtcgcctcccccggcacccacggtgagcggcagcttgtactcgatcgtgcggggagacttgagcaaggtgacgcctttcgagaactgcgtcacgatgcgtagcttgtacttgccgtcggtcaaggccggtacgcgggcgatgatacggctggggtcgttttgcgtgaggcggcgggtcacgggcgtaaccttctcgccgtcttccgacacgaaaaagatacctaccgagctgtccgccccgttaatacggatacggtcgccctcgatcagtatgtcctcgttcggggtgatagagccgttggacaatcccgtgaaggtatcggtcaccatgccgatgcgccccacctcggacttggctcctagaacctcgacgcccaccttgctcaacgcgtcacgcatctcggcggagggcacgatatcgagcgtcagcttatggatagcgggatcgaacttcgccgtctcgcctccccaagggcccgtgatacgaggcgtgtactggcacacctcggtgagtaggctgtagcccatcatgaggtgctcccgcacgatgcggtcgcgttgcttgataatggacagcaaggtgtcatacttgatctcggaaccttccttgatgatggcgttggctatattctcgttgtgcagggtgtctttttgtgtcaatacctccgctacgtagtcgttgtcgtcatccttggttaacaaattcggccgaagccatactttccagtaatactcgtttgccatgattggtttgtttttaagttgtttataattcgtaatgtgtgatcttatttgtttgtattctttacatgtcagtttgcttgcacgcaacggacggcgaaaccgtaagccttaccactcacggtcgctgaaggggtcgtggccaagttgtatttaaattcaatgtaccagccatattcattataataattttttcgtgagttcgccccgaataaggaaaaacttggagctagttctccattaaacgaacagggggttccatcaatattacgctcggggtcccttaaaagaccggtacttatttcacgcatcctgaaaaaggggaaccacgcataatccccttgcggtgtctcatattttattccattcatgatatggaaggaattcttgttgacagcgatccctgtcgttttccagtcggagtttactaacatttgaaacttgttagtaccccacgaaaaaccactccagatatttttcattgccgtatcatcgaaatccgggactctccatccggccgggcatggatcgtacagggccttcgccgtaggtccccacgagccatcggccgccttatagcctatatggaattttgatggattccggatcgtattctccaaactgttactattcaccttttcaagatcaataatctccccatccccgttaaacattaatcccttgtcatcccttccgccatcggcggagcctggcatcgggtctttacgaccccattgataaatattgccgtaagcacgggcggattccaaggggtttgtcgtagaccacgtattgcgaagggctcccaaattgcgatccatgattaccttgccgaagaaagctccggacgtggcatcagtccatgcgtctccggcgtacgtatgtaccgtgcccccggcgctagcgctcttggccgtccggatagcctcttccctgttcgccgccgtgatcgttcccgacaggcgtgccggcacgtaatccgtgatccatagatgccagctccagaggatcgtggcaccatccacagcgtacgccgcgatcacggcgttgccgccttgcgtgaccggcaccctcacgtggacaagggcatttgccctatcgccgatattcgtatagttcaccagattctgatggttatagctacccgcctcattgctgacggcgtaacccatcaccaaatcacccgaggttccggcgtccttgctctgccacaagacacggacgctaccgatcgtcttatcggacaggtaggtgttctcgccacccgaacccgcctcgtgcttataggggttgaagcagatgttcgtaccgggacgcatcatgaagcagttcgatgtctggacgaggttcgtgctgatcaccggggtctgatccagcaatcggatacggggatcgccacggtagtcggtgttccggatatttatcgtatagtggtagttcgtgttctccagcaagttgaagtccgacacatccttgcctcccaggtaggcacggtagtacatgcgttccaacccgtcattgttgtccaccacgaactccatataggtagccgaggtatgggcgtattctttcgtacggtaatactcggaggtcacgctacgggacttgcctttcgcgttggcgggcatccaagtggttaacgagccttcgtttgtggcatcgacacctttcaagcggtacaagtccttgtattccaccgtggagatcgggtaaagatcgccctcgaagcgagagtcggtctccgtcggggacataagataatagacagtgggcacttggcagagttttacctccttcaaggtatagccggtacgcaatccctcggcgaacttccagttcaccgtgagacgcacggcgaggcgcttcaaaaggatacgggcatcgctaccgtccgcgctttggatgacgatcttgccctcattcgtcacgttcacgttcttcaaatggatgaagtaaggcatggcgttaatgtcgttggtaccaccatcccctatcccattgatggtggaggcatcggcaagccttccttgaaggtcgctccagctagggctgccggaaaattcggatatggcgttcgaggagccacgggccacgatgataagctggcagttctcgcaagcaaccaagtctacggtcaatgttgagccagtggcttggctgactgtaggggttagcttcttgaaattcctgttggaatcatactgcaagatctgcaagttatggagttggtccggcttggcactggccaaggcatccgcctttgtccggacagcggcaggcaccagacaaacgtcgaaggccccattattcctcgtccctacgctcttcgtcccggatgatccggcattcagtgacgccgcatccacctcgtcggcgatacccacgcacaaggatacctccaccgtcttgcctccacccgtagacgggcagggtgagggcaagacggtggaggtatcgctatgcgtgggattggcagactgggaagatgcggcggcattgagtacgagatctatccacacggaggctaatgaaggctttggctttgatgtgcgtctgttctccggtcaaaacatgggcacgaaggctataacggttcctgaagatcccttggctacggccaaacccgataagttatatggtttggagatctggcaatacgaccgggcgggaaattgcatcaataacagcacgcaaaacctgggtaataaatccataggggaatccttcaccgtgcctttggtagattctgcgacactgtcaacccccgagaccgaatgccaattgctgatcgtcgcccgtggatataatggctcgaaaaacacgattgagtcccttaagggcaagaggctgtcggatattcaggacatgatgctggattcttcggtaataaactcgataacgacaaaggatcaaataaaagtgatgccctatctcttgcttctccctcatgtctgtatagtgaaggagggcgagacgtataggatacagaacccggagggacaggatatccgcgtcttattacgccgtttggcttcccggctgacgatcacatgggaaaacgtctcgaaaaacacgggatatgtcttgaaacaagttatgcttcaatccatacctgccaattaccgattattgcgtcatccggaggacaaggcgacatatccctctttactggatcaatactctaccttgcaggttcccgatgtagaggagtcgggcagctatacttgctggatccccagtgtgctacgaggcgaaagcccgaatgccacgtccctctattatcgcacgaaagcgaacgctccgaaaggtagtgtttacgttacgctggtatcacaagatcctgtgaatatcaagaaaaaattgagttaccgtgtctatttgggaggaagttcaagtcatgatttcaatctgtacgacaatacgaactatgtttacgggattaagatgtcacactcggagcttccggtggatgacaaacgtattaccatcgtgaatccgatcggggcttccgagaataacaataacttggttcccacggccaactgtttcatgattgttccgggaggcgccttttgtttcgatccctataaatatacggtcgatgggacggcggatcaagagaattccacactgaaagggtgggctgacacggaggggggtatcacttccgtggaacttttatggcagaccttggaaagcggagatttgggagatccggtaatgggtatcgtaaataccgaagaggatcatacgaatattgtggacataaagagagacgacggtcaggatataacgaagaaccccttgtctggccaggggcaaggacggatctattgccgtgtcgcccctaacacgaccggaggtagcggcttgatagcggcgagaaacgacaaaggcgatattctctggagttggcacgtatgggtgacagattatcatccggacgctaccggggatgcctcggtagacgagccggagacaaaacgtaagcaaaaatatacgtatgggaatcatccgaatcaatatcctatcatggatcgtaatctgggcgctttagccggatataccacgatacccgcagaagaggaggataggtcgaaggcacatggtttccattatcaatggggtagaaaggaccctttccccagtagttatactacaaagtacgtgtccaaaatagagcgtatagatttgactaaatccgtgaaaaatatattgaatttatataggccggatggtgttacttattattcacgtaagatagtaccttctgccacgacttttagggaagcctataaagacccgtcatctatttataagccaagtggcaataacgctgataatctttcctggatcacgaatctaaatgatgtaaaacaagcttggggtggtagttcggtgaagaccgttcacgacccatgtccggccggctggcgggtgacaaaagtggagaactattatcccttattcaatgatgtcaaccatagcgctacaggtcctagcctgtatttgatgaatatgcaaaacaatggcgaaaagacagatgggggtatcgttgtctattttgataaagagcagaggaggacgacctatatccgatataccggttattggtatttgagcgatcagtatcttgggattggtgagaacacgttgctttggtgccgaaacgacgttgcaagcaaagctggcgctaaacatttcagaagggattataatctgactgctaaatatggaaccttgcccacttccggacatttacgtgaggccatacctcttcgttgcatccaggaacgggcgaattgatacgacgaaccataaaggctcccccccttgtgccttgccgtaaacgcttggggaaacgttctttgacatgatgagattaataaggaaaagtgataatcgctgttgtcatataaattgttatatttgtattcacaactcaaaatagggatacttatggaaacgagaagactaccgatcggcatcagcgattacaagaaaatgatagatgagggctattactatgtggataagaccgattttatccgtcagataatagaagaaggcgctttgatcacgttgttgccccgtccgcgtcgcttcggcaagacgctgaacctttcgatgctgcggtacttcttcgagaagacggatggtaacgtgttccgcccgttgttcgacggcaagcgtatccgggagtggaaggatttcgataagcatcaaggtcaataccctgtgatcatgttgacgttgaaggactgcaaggcggatacgttcgaggacacgttggtcaggataggctatgagttgaaaaacgagtttactcgccatgcttacttgctcgattctcccaagatgcggcctaattacttggatgactttatggcactttatgagggcaaggcttcccgggggcaattagagggttccattagcttgctatccgaactgttgacgcttcattggggtatgccccctctggtattgctcgatgagtatgacacccccattcatgtggctttcgacaagggcttttatgatcggatgatcgtcttcatgcgcaattttatgtcgatggttttcaaggacaatacgtctatcttccgcggtgtaatcacgggtatcctccgtgtaagcaaggagtcgatctttagcgggctgaacaatatcgacgtggataccttgctggatcgtccgatgtgtacggcgtttggcttcacgcaagtggatgtcgacacgctgctcgactcatactcgttgggtgatcagaagtcagaggtcaagcactggtataacggttacctgttcgggaatgaggtggtctataatccatggtctgtattgaactatataaataaaggtggtgtctttgccccttactgggtgaacacgggctcagacgtgttgcttcgtcatttgatagcggagggcccctcccaagtacggaaggggatcgagacgcttgtccaaggcggtagcctgtgtagcgtgatcaacgacaagctggctttcccggacttgttgtctagcgcgtccaacatctggtctttcatgctgttcagcggctatctgaaagcgtcggaggggagaatgaccccggatcacttgatgtcgtacaccttgggggtgccgaacacggaggtttccacggttttttctacgatcatccggggctggatcaacgacggccccgtgaagaacgaccgcttggagatgatgctgcaggctttggacgagaacgagatgaatatcttccagcggctattgaatgacttcgtcgtgaatacgctctcctattacgacacgaacggccgtgagccggaaaaggtctatcaggcgttcttgttgggaatgctggttagcaacggcgcgtacgaggtgagcagtaaccgtgagtcgggtttgggccgttacgacatccttcttcgtccccgtgaccttggtggcaggggttttatcatggagttgaaagtgtacgaccctatgtttgacgagtctgtggacaaggtgcttgattccgccttggcgcagatcgagaagaagcaatacgccgccacgctccatgcggctggggtgcgagacattctcaaaatggcgatcacgttcgatggcaaacgtgtgtgggtgaagaccaccgagtaaaataacactccttatccttattaatcccgtcatgcgatgatataattgttgtcgcatgcgtgaagttacacggtacccccgtcgggtatcgtgcggtttcgtgcgtgcctttccggacagtaagtccgaaatgttaaatgagtagtgatttgtaaagagacaaaaagcgaaatgcatgaaaatgtaaaaaaggaaataaaatggaagatattgagaatgaagggatgaaagaaaaaaagttgtctctttcttacgcagaaagagacaactttcagaatgacggataaatatccgttttcggacgtaaaagtagctcaaattgctgataaaggcaaggtgagtgcttaaatcttttgtcaaaattaaaaaagacaaacaatagcgagccgtcaagcgtgacatgccttgtcctattaacatttccaagggcttgaaaaacagcggataggagcgtttattctcctgttgtctctttctgcgtaagaaagagacattttttttctccctacttctttattctcaatcacttctatttttcgattcattttacattatcgttttttttaccgtttgtctctttacatctcactactcatttaacatttaggacttactgtccggaaaggcacgcacgagctagcacgattcccgacggaagaaccgtgtaaagatccatacatgcaaacttcatattgttacatgacgttgaattaaatgtctaattgtttcgattttgtctatattcattaggtgtaaccccaaccattttcttgaaccaacacctgtacgtagaagtgacaggaatggtggaattaaagttgtatgtatctttcaagcaattacaggaaagccgacgaagctagcttactttaaaacaatggatttgaatggaaaaaattcataactatgaatgaagaaaaacatagttatgaattgaaaatttcatagttatgatttttcagtatcaaaataggcaagtaattcttctatcgtttgggtgatataggtaccgccggaagtctcatggatgataaagtgggtggtctttaaatcgccagtctcaatccagatattcgattccacttcccgattcgccaaaattccgtttcgctggagcgctttacgcaccatagcgtatttctggccatgtccaacgaggcggatctgtcgggagaattgattatctatacggaataatccggtatccttatcgaaaacaatccctttccgggcgaagaaattgcttaaatgaccactcaatgccaaatcctcgggggtaccggtagagataccattcgctttgtccattaaccagatcttatccgatatctggagagccagttccaaatcgtgagtggacataaatatcgtcttattcgttttccgggttagatgatggagtaattgcataatctctaccttgctaggaaaatcaaggaatgcggtaggttcatccaagtaaataaccggagtctcctgagcgagcgccttagcgatcatcactttctggcgttctccatccgataaggtatggaccatgcgggatgctagttcctcaatgcggacaagggcgatggattcttccacgatccgcttatcatccttgctcaacttgccccagaagccggtatacgggctacgtcccatcccgaccaattcccgtaccaacatattccggatctcacatttatcggtcagcacgacaccgatcgtggtgctcaattccttatcggaataagcatctatatcttttcctaggaccaatatttccccatctaatttaggttggaaagccgataacgtgcgcaataaagtagacttccccaccccgttagcacccagcaaacaggttaattcaccactatagatcgtagagtgtatacctttagctaccagctttgtactactcttagaatggtaaccgatcgaaagtccgttaatatgaatcgtatcttgtttcatcttactcgttcaattcattctttcgttttctaaataataccgaggccactacaggagcacctactaaagcggttaccgagttgacaggtaacgctccctcgaaccccggcatacgggcgatcaaattacagatcaacgccaacgccgcaccggcgaataagaccgcaggcattaaaatccgatggtcggaagtttgaaatatggcccggcataaatgcggaacggctagccccaagaagataataggtccgcaataagccgtgacaatcgccgtaaggaccccggccgaggtgataaccaacaaacgggcccgcttgatattaagtcccaaattgcgtgcgtagctatccccaagaagcatcaagttcatggtcttgataagcaggaacgagagagggatcaagactgtcataagaatcacgaacaacgtcatctgattaccggaaacacgggcgaaactacccaatccccaaatcacgtatgcacggatatcctcctcgacgctaaagaatttaagtacaccgatcacggcgtttgccacgtaaccgatcatcacaccgataatcaacaacgtgacatttccttttaccttttgggaaacatacacgatcagcgccatcacggataaggaaccgatcacggccgctatcgataaggcgatctcccccataaaaccaagtttactcaaggcaacgccccctaaactaccgcttaacaacaccacgaaagcgacacccatgctcgctcccgaactgatacctaagaccgaaggtccggccaatggattacggaaaacggtttgcatctgtaagccgctgatggataagcctgctcccgctaccaacgctgtcaatgcctgtggtagtcgggatttccagataatattctgccatgtaataggctcatttcctgaattccagataatatgccaaaccgattgaagaggaatagagactgaccccaacaccaaattcaaaaagattagaacaaaaatagccgtgacaatcgccagcatccatagggtatttgaatgtctcatcagcgttccttatttaagtcgagaataatagaccggctcatgatccggtaataaatccggatgaaagatatgaagcaaatccgctaggacgatctccggttctgtcggcatactctcataaaacggcgtgttcttcatattacaatagataatccctttctcccggaacgcacggaaatccgcataacgaggatcttgctctttcaatgcctcatagctaaacgttcccgggaaactattcacgatacgccagaaatcagcatcgtccgcttggttatagaccgtctcgaagtctaatgtaacaccaccggatcgctcatcgtctttcaagaaataatcagcgccggcatccttgaaaagctgtgccaagaaactctttcctcctacggcataccagtttccaccccgtaactcgccactaaaaacgatcggacattttttaaccttgccatccgccgtaagttcctttaattcattatacctcttctcaatggcggcaaaacgctcattgccctctttctctacccctaacaacaagcctatgaacttgatccattcagcttgtcccaatggcgtagtctccttataacccaaatggggaatcaaggggatacccacgtctttcagcgtctcatagcctccccgcttgaatggcgatacaaggatcaaatcaggattcatactcatgataacctcgttatcgaaatttccctctataccgatctttgcggttttaccttctttcaggcgttcgttcatctctttattgaacaaatgccgtgtactggtaatcccaacgaccttatccaaggcacccaatttaataaaattcgataattgcagggaagtcatacagataacgcttcggataggaagctctatcatcgtataatcaacgggaatccccgtgggtttcgaacctctttttacgaacgcataatgaaacgtggtgctttcctcgttttgaggatcttgaatatcagccaagacatattgatccgcataggtaagcttgaatccttgggcgtataaaggcttaacctgctcttgcgagaatgcggattgctctacggaagccgtcttccctatttctcctttttcacggatacctgaagtacatgataaagtcaataccgataaaagcaagcatccacccgctataaacttattcataatccttgtttaattgacagttgatcattgacagttactctcgtcctgctccacgggacagcaacatttatttatgaaccggcaggtcttctgacttacttccattctggacgccttcccgattacgaaaccagtggccaaggtattgtccgaatgtttagaagttcacagcagcgtggtctgtccgggattctcacccggttcccttttaatccgcctcccggaaaaagagataagcggagcctattacagcgacaaaagtagtaagaatatttgtatacatccgcaattttaaggacttttgcgtttcaaataaaaacagatacacatgaatcatcctattcacttcgtctcattaggtcccggtgatccggaattaattacgctgaaagggcttaaaacattacaaaaggctgatattatctattgtcctgctacacaaggcaagcatggaatcatatctcgggcgacggatatattgaaagctattgaggtagacgaatccttgatccatccgtttattttgccaatgagtaaggaacggacagatgcgttaaacgcttataacgaattgtttctggatgcccaagctgaatatttgaaaggaaaacaaatcgtgatcgtcgccgagggagacgctggtttttattcatctatacaatatgtatacgataaattcgaggaagcaggaatcccggtcgatcgaatcgcaggaattccggcatttatagcggcaggtgccttggccgggatacatatcgtaaaacaagaggagcaaattaacgtaatccccgggactgcgtcgttcgatgaactttcggcaaaaatagaaaatggaatgatcatcgtcatcatgaaattaccgggttgccaagaggctattcatacttgtatccggcagtatgcggataaggcggtttttcattatttcgagaatgttggaacaggaaaagaatattatactactgatatcaccactatacattccaaggatttcccctatttctccctactgattatccaacctcgctaaaagaagaaggctgcccggagagtaaccaaacccggacagcccatcttattacgctacatgcaatatatgcttaagctgatcgatatggaaacgaagtgtatccatataaggtttcactgaattatgatacatgatcgcttttgcgtgcatatcttccaactcgcttactttacggttcgcctcacgcattttacaagcgttgtagcgaatacccgatacatgtcctttgatatcctcgatcgcttggtttccccggttgaagatagactctgcttcttccggagcgtataccgtataggcttgggcaacgtcatccagtaatgcctgttgataagagccggctatcgggagcaattgatggatcgcatgatgacataaagaatgaacctcgttttgaagcttcttcaattctacttcccactttgattcacatacttcatccaattgtttgacttccgctacgacacggccgctaaacaattccactaccatcttttcccatgcttctgctacccacgatttagtagcaaatgtaacctgactaaatcttactgttgacataaccttaaatttacatattatattgctaatgttattaatctcttatctgtttcaatttatcacactcaaatcattttatctttctttttatcgttgcgacaccacaaaattaatcaaattatcatagatggataattttaaagactattttataattctttaagagtgcgacaagcaaaacgtatgatttttgcaaagttcactttacaaaaagtttaatttcaagcctaacagctatcacaaaaagcaagatcatcgccatcttcgcacaaaaatatcaaaataacacaatcttattattccataaagggggaaaaccttgttccgtatcattttgttattataataaattagatttactttgttcaaactatataaacttacataaagcacatgaaatcggacattgagatagcaagagaaacagacttgcgtaaaattaaggaagttgcgacaacgttaggtatccctcgtgaggaagtacaaaattatggcaggtatattgccaaggttcctatccatttgatcgataaaaagcaaatggaccagcataatttaattttagtgaccgctatcactcccactaaagcgggaatcggaaagactacggtttcgatcggtctggctttaggtctgaataaaatagggaagaaagcggtggtcgctttacgtgagccgtctcttggcccgtgtttcggcatgaaaggtggtgctgccggaggtggatatgcccaagtgcttcctatggaaaacatcaacttgcattttacaggggattttcatgcggttacttccgcccacaatatgattaccgctttattggataactatatttatcagactcgcaacacctgcgaggggttaaaggagatcaaatggaaacgggttcttgacgtaaacgaccgtagcttacgtaacatcgtatcgggtctaggcggctcggcgaacggtgtccctaccgagaccggatttgacatcactcccgcttcagagatcatggcgatcctttgcttggctacggatatagaggatttgaaacgacgtgtcggaaatattttattgggttatacaaacgaagataagcctttcacggtaaatgatcttggcatagccggagctattaccgtattgctaaaagacgcattactgccgaacctagtacaaacaacggagaatactcccgcatttgtacatggaggtcctttcgctaatatcgcccatggatgtaattccatattggccacccaaatggctcttacttatggagattatgtgattacggaggctggtttcggcgctgatctgggcgcagagaaattctttaatatcaaatgtagaaaagcggggctttcaccgaaactgacagtcatcgtagcgactgcccagagcttaaaacttcatggtggcgttcctgaaaaagaaatcaaggaaccgaatatcgaaggattaaagaacggattcgctaacttagataaacacattgagaatatgaagagcttcggacagcaagtaatcgtgactttcaaccgtttcgctaccgatacggacgaggagatcgctttagtggctgagcattgcaaggaaaaaggggttggattcgccatgaataacgttttctctgaaggaggtgaagggggtacggaacttgcccgcttagtggttgatacgatcgaaaatcatccttccgctcctttacaatatacatatgatctgaatgatccgatccgtacgaaggtacaaaaagtggcccagaagatatacggagcctcttcgattgtttatacgactttggccgataaaaaattgcgtcagatcgaaagcttgggtatttcccattatccgatctgtatcgccaagactcaatattcattctcttccgatccgaaagcttatggggtcgccaaggatttcgaactaaaagtacgagatgtaatcatcaataacggagccgagatgatcgttgtcgtcatgggcgagatcatgcgtatgccggggctccctaaagagccgcaagcccgaaagatcgatatcgtggatggcatgattgagggattgagttaatagacagtaaaacaatttaaataaaaaaaggtacgcctcacacattcagtaaggcgtaccttttttataaccactctcgccccgaaaccggggggcgatcaataagctctggcgaacagtacccggcaagccgacggtttacctgtcaccatacacttacccggagtcttatcaccagctaaaggaatacagcggatcgtagctttcgtctcgttcttgatcaattcttctgtttccggggttccatcccagtgggccatgatgaagacgccatcctcgatcttctccttaaattcctcatacgtatctacgtttatgatgttagcctcacggtgatcgtacgctttcttgaagatattcgcttggatttcctccaacagattcttcacgtattcctcaatgccatcacacgtgatcgtctccttctccaaagtatcacggcgcattacttcgatcgtattattctccaaatcacgaccacccatagccaaacgcacgggaacaccttttaactcgtactcagcgaacttccagcccggcttcttgttatcagcgtcatcatatttcacggaaatgcctaacgctttcaatttagccacgataccagcgaccttctcgctgatctgcgtcaattgctcagcgctacggtagatcggtacgatcacaacctgtatcggagccaaatgtggaggcaataccaaaccgttatcatcagagtgagacataatcaacgctccgatcaaacgtgtggaaacaccccaagaagtagcccaagcatagtcgctcttaccgttcttgtcgatgaaagtaacgtcgaaagccttaccgaagttctgccccaagaaatgggaagttcccgcctgcaaagcttttccatcctgcatcatcgcctcgatcgtataggtatccaaagcaccggcgaaacgctcgctctcagacttcacgccctttattaccggcattgccatataattctctgcgaagttcgcataaacgtcttgcatcttcttagcttctatctccgcttcttcacgagtagcgtgagcggtatggccttcctgccacaagaactcagccgtacgaaggaacaagcgagtacgcatctcccagcgcatcacgttcgcccattggttgcacaagataggcaggtcacggtaagactgaatccagttacggtatgtattccatataatggtctccgaagtcgggcgaatgatcaattcctcttccagtttagctgccggatctacgacaacccccgtaccgtcatgatttgtcttcaaacgatagtgagtaaccacggcgcactccttggcgaacccttctacgtgctcagcttctttgcttaagaaagacttcgggatcagcaaggggaaataagcgttcacatgaccggtttccttgaacatatcgtctaggatacgttgcatcttctcccagatagcgtatccgtaaggcttgatcaccatacaaccacgcacggcggaattctccgccaaatctgccttaattaccaaatcttggtaccactgcgaatagtttacacttctcggtgtaagttctttcagctcttttgccatttctttatatttctaaattatactgttttccttaatctgaataagtaatgggttgcaaaggtaagaaataatcgtatatctttgtaaaaactatatatagataatatcatgaatatacacaagatcacacgttacttacttatgttatgtacatttacgttcttaactctcacggcgaaagggcaagatggagagcctttgcgactggccgtggcaggggtatcccacggacatctatgggaggtgataagccgtttggatagaggcgatttcaagattgtaggagtcgccgagaaagatgattacttacgggaacataacggtctgcgggataagctggatcctaacctattctatgcggaccttggcgagatgctggataagacccatccggaggcggtcatcgtatacgagccgatccacgaccatcttcgtgtggtagaggcttgcgcaccgagaggcatacatgttatggtagaaaagccattggccgtcaataacgaacatgctacccgaatggcatcgctcgcccgtgagaaaaatatcttgttgcttaccaactacgagactacgtggtataatactaaccatgaggcattccgccttatcgacagcggtgctatcgggaagatcgatcgtatcaacgtatacgacgggcatcaaggtcccttcgagatcaactgcggaaaagagttcacggactggttaactgaccccgtgctgaatggcggcggggcggttatcgattttggatgttacggagccaacttagccacccgtctcatgaaagatgaaaagcctcttagcgtatacgccgtactacggcagaataaaccgaatctttatcccaaggtagacgatgacgcgactattatcgtggaatatccttccgcgaccgtccagatcatgggatcatggtgttggccgatgggtagaaaagatatgcatatctatggcgacaaaggatatatctaccaagatacacctaaggaaatgcgaatttataccaacggaaaggagcgccaagaaatagcaccttccttgaacgctccttataatgattccttttatttcttgaaagccgctgtccgtaaagagattgacgtacctcccacggacctttcctcgttggagaataacctaatggtagtgcggatattggacgctgccattcaaagcgcaaaatctaaagcggttatccagctcttttgagagtttaaaacacctctttccaatgttttagattcgtatcgatggtatccaagacctccttgcttcgcccctccatcattaacttatacatggtttgggcaaaaccaagcatttgggagaactcaatcttgggaggcatcgctaatgcgttcggatcggtcatgatgttaaccaaggccggtccgtcagcgttaaacactttctgcaaggtggggaatacatcgtcggggttgatcacgttgtagcccgccattcccattgaaagggctacccgggcgaaatccgggttcaacatcgtggtctgccaatccggcagtccagccacctccatctcaagttttaccattcctagggaacggttattaaacacgattaatttaatcggcaaatggtattgcacgatcgtagcaaggtcgcccaacaacattgagatacctccatcaccacacaacgcaacgacttgcctaccggggtaagccaatgccgcccctatcgcttgcggcatggcgttcgccatcgagccatgattgaatgatcccaacatcttccgcatacccgtagcttgcaaatagcgggcaccccatacacaagtcatacccgtatccacggtaaatatggcgtcgtccgagctaagctcgtctacgaccgagatcacgtactctggctgtatcttctcttctttcccccggacagcggcggcagaacggagattttcccgaactttctcatatttagccaactgttcccgcaagaaactatcatcttctttctggtgaatcaacggaatcaactcatccaaagtatccttcacatcgccacaaagccccatttgtatcttggcacgacgccccagacgattcggattgatatccacctgtacgatcgtgttgctctctggcatgaatgcctcgtatggaaaatcggttcccaacaacaccaacacctctgcctcgtgcatactataatagccggaaggcatgcccaatagaccggtcatccccacctcgttcggattatcgtattggatctccatcttacccttgaaagaataggctaccggagcattcagtaatttagccaactgcaccaattccggatgggcatctttcgcccctattccacaataaagtgtcactttctttgcgttattcaacaaatccgctaattcccggatttcctgttcggcgggacaaacccgttgtcgcgtaggaaaagaaatggtagaggacaaacccgctgtagcattctctgccgccaagtcacctggaagtccgatcaccccgaccccacgtgatgagatcgccgcttgcatagcgccttgaagcatccggggaaattgttccggcgtagtggctacttggttataatagctacaatcatcgaataatttgatcgtatttgtctcttggaaatattccgtaccaaactcccgggaagggatcgtggaagcgatcgccaagacccgtgctccggatcgttgggcatcatacagcccattaattaaatgtacatgcccggggccactactacctgcgcaacaagccaactcgcctgtcaactgggcctccgccgcagcggcataagcccccgtttcctcatgacggacatgaatccaccgcaatctgccgtttttccgaacagcctcgttcacctcattcaggctatcgcctgtcacggcgtatatacgtcgtacgcctgctttttccagcgtatccactaactggtccgcaactttcttcgccatagtttaaactcttctttttattttataagaaaactatcaagggctggagaaagtttttggaaaggctgatttttatttgatgcaatccgtcaatgttcgtaaaaaagcgacaatcgcagtctcctcttcctgagataaagctaagttccccagttcatccttatttacggtctcgggatattccgccggggggaaatcctctacatcccttacattatgaagctaaatagacacttcacgaccccttccgaggtgatacgggcgtatttatcggcaaaacctttttccgggatatggcatatagtaaacatatcaccaaatgtacgatttatttctcaagatatatgagcgatggcctctatttatggagagacatccccatgtagataccgatgcaataaggaattaaccagatgaaccacacaacaatgctaaatctgttgaaatgctgcttggcttttaacgaacctttaaagtaagtccaaatcgcccagatcgcatggattagcatcaagcaaatagcgataattcccgttacggtatgcgccgtatcatgcagatgggtcagctgggcgatatgctccatcaagcccgttccaatagcgtccgcataaagtcctaatacaaaaaaccaaagatgccacgcttttaactgtccttggaaacgctcgccccagaccccgatcgtatagcatatcaaggcggatgatatcacacaaatggccgtaatcagtaaatgaatatcaagttgattgaataccatatttttcctttttcaaaaagaacagaagcttcctaaaaaagttcaggctattggcaaagaattcatacattcgcgtgtctaaataaaaacgacagggcaatcccgttgaaaaatatgaaacaaaatatactcgctctctatctgatcaagttatccaaatggttctcgctcgtaatgcctatcattgtccttttctatgaggatcatgggttaggattgcaagacgtatttattttgaagagtgtctactcggtcgccgctgtcgctttggagattccctcgggctacctagcggacgtatggggacgtaagaaatgcttgattctaggttgtatactgttctttggtgggtacctatgttattctttcacctccactttcacggcatttctctttgccgagatcctgttgggaaccgggcaaaccttggtaaacggagcggattcggcgctgctctacgatacaaccgtacgatataaaaaagaagaactttacttgcggtacgagggacgtatcacgatgatcggtaatttcgccgaggccatcgccgggatattcggtggattgctggccgcttattccttgcgattgccgttttacgcccaagcgtttgtcgcctttatcggcattccggcagcgttcgccttgcaggaattcaatactaagagtaaggtgcagaacccggtttccgagattctccgcattttgaaatattccttggttacgaaccgtaggctatgctataacatcatgttctccggtatcatcggagccgctacattaacgatggcatggttcgtgcagcccgtattgatgaagttggaaaccccgacctcctattacggtgtcatttggaccgtgctcaatctgacggtgggattgtccgccctctattctgatcaggtagagcggtatttcgggatgcgtaaatcaaacacgtttatactacttataatcgtaggtggatatatatcgctcgcttataaccttacttattggggattagcgatcttgttcattttctatatagtccggggcttcgccacaccgattttgaaaggttacattaatcaaatgaccttctcggagatgcgggctacggtcttgtcgatccgtaactttgtgatccgcttgatattcgctgccatcgccccatttataggttggctaaatgatttctattctttacgtgtcgccctgttagtttccgccggaattattgccatacccggaattttattcttagttttgcaattccgtaaagcagattaaaaatataatagcatgaaaagacaacttatgaccggactgtttgccgctttggctttcacagcggtagcccagtcgaatgagtggcgagaccccgaggtcaacgccgtaaaccgtgccccgatgcacgccaatttcttcgcctacgagaccgccgaggtggcagcgaaggacgccaaggaacaatcccagaacttcatgaccttgaacggtccttggaaattcttttgggtaaagaacgctgacgctcgtcctaccgatttctggcggaccgattacaacgacaaaggatggaacaatatgcctgtgcccggtgtatgggaactgaacggatatggagatcctctctacgtaaacgttggttacgcttggcgtgagcaattcaagaacaacccgcccgaggtccctaccgttaataaccatgtgggttcctaccgtcgtgagatcatggttcctgccagctggaacggaaaagagatcatcgcccatttcggctccgttacctccaatatgtatttgtgggtaaacgggaagtacgtaggctatagcgaagatagcaagctggaagcggagtttaacttaactccttacttgaaacccggacaaaaaaacctgatcgctttccaagtattccgctggtgtgatggcacttatctggaagaccaagatttcttccgttacagcggtgtcggacgtgattgttatttatacgcccgtaacccaaagcaacagatcgccgatatacgtgtgactccggatctggacgctcaataccaaaatggctcgttggctgtcaacctgaccatgaagggtaaaggtacggtagagcttgaactattggatgcccagaataaagctgtcgctacccaatccttgaacgcttccggaaaggtcagcacgacgatagaagtctcctctccccacaaatggactgcggagactccttatctatatactttacgggctactttaaaagagggaggcaaaacaatcgaagtaatccctgtaaaagtaggtttccgtaagatcgaattaaagaacgcccagatactcgtgaatgggcaaccggttcttttcaagggtgccgaccgtcacgagatggatcccgatggcggttatgtcgtttcacgtgaacgcatgatacaggacatacagatcatgaagaaattcaacttgaacgccgttcgtacctgccactacccggatgataacttctggtacgatctttgcgataaatacggtatctatgtcgtagccgaggccaatgtagagtctcacggaatgggatacggcgaggaaacgttagccaagaacctatcttataagaaagcgcatctggaacgtaaccaacgtaacgtccaacgtggtttcaaccatccgagtataatcttctggtccttgggtaacgaggcgggatacggtcctaacttcgaggccgcttacgattggatcaaaaacgaggatcccagccgtgccgtacaatacgagcaggccggaaagaccggaaagacagatatcttctgcccgatgtattacaactacgaggattgcgctaaatactgcgaggacaactccatgcaaaagcctttgatacaatgtgagtacgcccatgccatgggtaactctcaaggtggtttcaaggaatattgggatttgatccgtaaatacccgaaatatcaaggaggcttcatctgggacttcgtggatcaatccgtacgctggaccggcaagaacgggaaaatgatctatgcttatggcggcgatttcaataagttcgacgctagcgataataacttctgcgataacggcttgatcagcccggatcgtgttccgaacccgcatatgtacgaggtggggtattattaccaagatatctggacaacccccggcgatctgtcgaaaggtgagatcaaggtgtacaacgagaatttcttccgtgacctttccgcttattatctggaatgggaaatgctgaaaggtggcaaggttgttcgtagcggacgtgtcgatgacctgaaagtagctccccagcaaacatcaacaatccgattggatctaggcgagacttgccaatgcacggaatggttgctgaatgtatcttataaactgaagaaccgtgagggtttattacccgccggacataccgtagccaaggatcagctgacgttgaatccatacaaggctccatctatggaattgaaaaacgtggagacaaccaatatcgaaaccaaggctccagtcgtacaagatagcgatgcgaattacctgatcgtggaaggttgtggtttccgtaccgagttcaatcgagagaatggttatctgatcaaatacgaggtaaacggccaagacatgatcaaggaaggagaggctttgactcctaacttctggcgcgcgccgacagacaatgatttcggagctggcctacagaaaaagtacgccgcatggaagaatccggagatgaagctgacttctcttaaccaacggatggagaacaagcaagtgatcgtagaggccgcttacgatatgccgaccgtatccgccaagttgaacttgacgtacgtgatcaataacaagggtgcgatcaaggttacccagaaaatgacagcagacaagaatgccaaggtatcccccatgttccgcttcggtatgcaaatgccgatgccgagatcattcgagaatatcgaatactacggccgtggtcccgtggagaattatatcgaccgcaagggtaacgccgacttggctatttaccgccagaccgtagatgagcaattctattcgtatatccgtccgcaagagaatggaacgaaatcggatatccgctggtggaaaatgctgaacgaggctggcaacggtatcgaggttgtagcctctgccccattctccgcttccgctttacattatacgatcgagtctttggatgacggtgcccggaaggatcaaagacactctcccgaagtagaggaagctgacttgacaaacctttgtctcgataaggtgcagatgggattgggctgtgtaaatagctggggaactatcgcactcccggaatatcaaattccttacggcgactatgagttcacgttcattcttactccggtaaaacatagcatcgagatcgagtaaaacgaatcttttatctagcgagagatatatgaaagaaggggaaagcaattgttgttttccccttctctcgttttctatcatcactattctttaacagccactacctacaaaattcctaaaccgttccagtccctttatcagcgaggaacgtggacaagcgatattccaacgcatgaaaccttcgccttctgctccatacatcgttccggcattgagccatagcttcgctttctcgatcagcaagtgctccaattcttccgatgatttacctaacttacggcaatccatccatacgagataagtgccttccaacaaggttatcgggaagtccggcagatatttcccgcaaaaatctttcatgtataagtaattctgccataaataatcgatcagttgcgacagccattcctctccctcattataggccgctatggtagctattacaccaaaaggattcacatcgcatacctcgttgatattgattgcccggtctatcttccgacgtaggttctcatcggaacacacgatattggcgatctgtaatccagctatattgaaagccttgctaggtgacaggcatgtcacggaatgccgtaggaattcttccgagatagatgcgaacggcgtaaaagtatattccggaaatacgagttcgcaatgtatatcatccgatacgactgttaaaccattacggatacatatctcgccgatatgacttaattcctcacgtgtccatacccttccagcgggattatgaggattacacaacaacatgacctttaccctcggatcagcggcttttctctccaaatcctcataatcaatcgtgaatgtatcatgggcataagacaaagggttgcggataatctcacatccgttattgcggatggatgagaaaaaacagttataaaccggagtctgcaccagtactttatcacccggctcggtcaacactttgataacggcggaaatagccggaacaacaccggaggtataaatcatccattctttccgtatttgccatccatgccgacgttcaaaccaacctgtcaccgcttcgtaatatgcatccggcacttgggtataaccgaaaataccatgttctacacgttgccgtaaagcttcgataataacgggtgccgtacggaaatccatatcggccacccacatcggtagtacatccgtgcccacggcactatcccatttataagagttcgtaccggtacgaggcactatttcatcgaagttatatctcatattctttatgcggaaaagcaagtacgttcattccatagcctcagttggcaattacccggagccttgatgttctcgtcgaggattacctcaccataactttcggcggtgatacttcccgtacggggattcttcacgctacggatcgagctgttgatagtcgcctgcacggaactgtattcaaaggctagatcgcaatcatctgccatcgtacagttctccatcataagatcgtgggcgtaacaaagcggctgcgtacccgagatcttgcaatttaccaaacgcaggttcttcgagtgccaccccaagtactcgccgttaatctcggaatcgtatacggtaacattctccgtattccagaaagcgtctttcgaattgatgaccgcattacggatttccacgttcttacaatactggaacgagtagtttccattttgagcgtagttccggattttaatgttctcgccgtgcataaataaataatcagcatgatctatttgcacatttatcaattccacgttccggcaatgccaaagggtttcttgagcattgggtagttgtacgttttccagtctgataccgtccatctcccgaaacatctttggggcttccacccgtgtatccgtcatcactagattttgggagtaccataacgcggcacgtccaccttcggtaaacaggctattcttgatggtgaagccatccacgtgccaaaacggatatttaccctcaaaacgacagcctacggctatgatattgctacactctttcaatgccgactccccggcatgaataacgacattgtctaattgtaaatcgtgagaggcgaacaaagggcgctcaccactaaattccatattctttatctgttgcataatggatcttatttgaagttttctacaaagaaccgttcaatcttatcgaagggaatgacattcatctgatcgtacaaatccacatgattcgctccgggtataattagcaattccttgttatcacctttcagtttcttgaaagcatcctcgctgaagtaacgtgaatgcgctttctcgccatgaataatcaatacggcgctacgaatctcgtcactatacgagagtataggcatattgatgaaagataaagccgaggtcttgttccatccgccattcgagttgagcgaacgcttgtggtaaccacgcttcgtcttgtaataagcgtagtagtctttcaagaattggggcgcatcgtcgggtaacgtatcgggtaagcctcccgcaagggcatatgagtcgtactttgcgtcagcggtacgctgttcattgagttgcttgcgcaattcataacgtgcgtcggtatccatcgcatcaaaatagccattagcgttcacacggctcatatcgtacatcgtagaggtaacggtcgctttgatacgagtatcgatagccgccgcattaagagccatgcctccccatccgcagataccgaggataccgatatgttccgcatccacatcatcacgtgtcgaaaggaaatcgacggccgcacagaaatcttccgtattgatgtcgggagaagctacataacgaggctctccgccactctcgcctgtatatgacggatcgaaagcgatcgtcagaaatccacgttccgccaattcctgcgcatataaacccgaggattgttccttcacggcaccgaacggaccgctaatagcgatagcaggcaattttccatccgcatgcttgggtttgtacatatcggcggcaagcgtaatgccatagcgattacgaaaagtaactttactatggctcaccttgtcactctgtgggaatactttatcccactccttagttagattcaaattcttgtccattgtatgaccggtattaaattgattgtctgtagcgaacagatttcccgtagcgcaaaagcatatggctattgccgtacataattctcttaatgacttcttcatgtcgttccttgtttatttttacgatggcaaagatagaagctcaaatagcatccctttgtagataaattacggatgtcatgacctcaattacaggttttgcggaatcagccagaaaacctgtaaatacacataatccgtaacaatggttatataatccgtaattagggttataactatatatgaattatcctctattttcgcatacaaaattattgattaaatacgtacggctatggataagatacttaacttagatagtgtagacctatataacaaactatatggcctcgaaaccctaaatccgcttgtcagtgtcatagatttgaataaagcgacgagtagtgtagatctcatccgcttcaattacggcatctatgcgctgtatctaaaactagagaaagcctgcgatatcaaatacggacgccagacatacgattaccaagaaggcacgatcgtttgcttcgcccccgggcaaacagcggaaacaaacccgaccaccgataaagtccaagtaaacgcacatggtattctttttcatcccgatttactgcgtggaacgtcactcggaaagagtatcaagaaatatacgttcttttcttacgaggtaaacgaggcgttacacctctcggaagaagaaagatctatcgtgatggattgcctgaagattatccgtatggaactggagcatggcgtggataaacatagtaaaaccttacttgtaaaccatatcgaactgctacttaattattgtatgcgtttttatgaaaggcagttcatcacccgaggcaagacaaaccgggatgtgctgacacgtttcgaaaatctattggatgagtatttcgaaagtgcactcgccgaacaggacggattgcctacggtgaaatactttgccgacaagctttgtctctcatcgaactatttcggtgacatgttcaagaaggaaaccggcaaatcaccgcaggaatacatccaagagaaagtaatcgagctagccaaagaacgtatctccgacacggcggacacagtcagccaaatcgcatattccctcggtttccaatatccgcagcacttctgtcggctattcaagaaacgggtaggatacacgccaagtgaataccgtgcgcagatcggtctatcaacgaatctatagaaggtgttcaagaagatgttagatattaagaccgtatatgaatgtaaccggtgcttgggatgcaagacgctgcacccacaagtaagcctcatcaatctagagagcccgaacctagagcaagaggccgtaaagttcgagttctatgcgattctcttgatagaagactgcccggacggttgttattgttgcggacgtaagtattacgattattccaacgctacgatggtattccttactcccggtgagattttccgtatgagcgagaataatacgttacccgacaaagggtaccttttagcgttccatcccgacctattgttccgcacgtcattggacaaccatattaagaactataccttcttcgcttataataaggaagaggcgctacatctctcccaacgtgagacagccaaagttacgtgttgtctggaaaacatcgaggatgagcttcaccatgccatcgatacacacagtggtaccattctatcccgccacattgaattattattggattattgtacacgctattatgagcgacagttcattacccgggagaataagaacaaggctatcttggagaaattggaaaggctcctcgacgagtatatcatttccggcaaattagagaacggccagctacccaccatcgaatattgtacggcagaactgaatctttctgtcgcttacttcaacgacctgttaagattcgagaccggcaaaacgctggaggaatattttcagttcaaacggttgagtgtggctaagacaatgctactgaaaaacggtaatactcccgctctggtagcacggcaactaggttatccgaacgtacagtatttcagccttatatttaagaagatcacaggcatcgcccccagtgaatatccatatgcgcaaaactaagaaacggaaggaggccatcccccttctgtttcttagaataacattattttcctagcttcttttccagcatcttcataaaatatcccccgacaaccgaacgggcttgaaaacctcgttgcgtaccatcagaagtaaaatgccaatcgcttagaggaacacgtgaagtcgtctcgttggcatagttccagaccggaatcatcaacgtattaaaatcctccatcgatccggtcaaacaagcggaccataaaatccagtcggacttcgtataatccttccggttatccaacggcaaaccgtatttattttgctttgtcttgtaataagccatttccatagcggcaacctcttttgggaagatattcaagcccagcaagcgatcccataccaagttgtatttctggctccaagtacccggcttatcgaaagtcaagcggtaatgatcgccatcatctgccatttttacccacttagcggccatctcacgggcggcttccgtatattgcctagcgatatccgtcttgcctaacatctccgccaatttcccgtagccggcaactcccataattgccttgatggacaaattcgtgttatgggcgaaatgcccggcgaaatcatccgtacaaagttggttcttcggatcaaggccttccttcaacaagtaattcgcccatgtagtcaaaacctcccaatgttgggcggcataatcggcattaccatccactaccgctatggcagtcgctagcacaagcatattaccactttcttccacgggcatatcgccaccgtaggtctgaccgttcgcaaccggatatgtacccacgtcgtgagccgggaaaggtttcttccacagtccgctctcgctataatagaaaatagggttcatcattcctttcaacaaatccgtattgtacactaagaataaaggagcggaaggatacgttatatccaccgttccgatagaaccgttgctgaaattttctttagagaggaataagagagtcccttctttatcagtcaccaatttatgggcggcgatcgcctgccggtatgcgatagcgcataactcggcgtacttcttccctcctacggcgctcgtctcgctcatcaaagaagaatcaaaggaatcgcaacgtctcatcagatcctcgtaagcagcctcccctttctcgaacgcctgatgaatatccacctttccgtcgtgcttccaataaggcatccggttgtcttggaaatactggatcgaatataaatcatcgtaaccgatcatcaaatgtccggagacggtttccttggagaccttgccgatcgggtccgtataagcgaggactgtcatttgctcacgcatatccgaagagatactttgcgatccagccggtaaattaccagtagtcatgaaagctttcttcgtagcataatactcgtcgatcgttgcggagactcccggtttctttgggatagccaaatagaaatatccccagtcaatccgtacatcatccccggttttcgccagaacctcttgatcgattgttcctgtctttaggtaaattaaatcaggggtttccgttttctcaaaagtcacctcttgatcgatcgtattcacggcccattgcggcgtggcttccatatataattgcacgtcgtgatctttaccgtcgatggagcggacttgataggttatataattaaacggagaagtcatagcttccagatcattcagcaagaagggagccgtgaaaatcaagtccagacttacaccaccgcactcaaaggtgtagaatgtttgcgtaggcatcacgttcacggatttctggatcgctttctcatcgaacgtatctcctcgtttcaccttccgcatgattcccatatccacataagcgcctcccccattgttccggcaatgagcggccaatacgttacccgtaggtttcaagctctccaccaccgcttccggtatctctttcagcaaatcatagtccagaccgttccctgccacggcgatttgctttccatttagatacacctcgatattatcatcgtgcgaatattggaggtaaagagcatccttgcgcacatccgagggccagtcaaacgtacgacgtacccagatatcgcctgcggaccaatgcgtggaacgattcggattatcttccgttccgaaagcggcttttccccgcttccaacctttcggatcataagcctcggcgaaccaatcaccggcaggctgagacatcgtataatcggcctcccataggccatccgaggccgtaccgatcaccgaggtcacctgtatatcgtccattcccatgaaacggtatgacttaccatctactcgtataccgcctagaagcggataatcacggccggtccaatgccgtaccgactcatcattcaattgatcggcaaacgaccatgcgcttgtatagggatcgatcgtgaccaaaggaacggccggagcacgtaaagagttctctgccgccgccgtatatacctcggaaacttccacttgcgtacaacaagataaagccgtacaacaagataaagccaataaatagtttctcatctgcttactttacggttttatgaatggcctccagcacgatcttctccatgatcttatagccttccaaggtcggatgcacaccatctttcgacaggttagcgggcaatccgtttcgctcatctttcatggcggaatgataatccacgtacgtcaagccattcttatccgcatactccttgatccacttattgagctggataaccttatcggccggcttcatacccggtctccaaggaaaatcgtatgccggcatcacggaacaaaaaatcacctttatattatttactttcgccaattccgccatggagaccaagttaccatacacgttctctaaagcgatcacgccgttattgtgggcgatatcattgatacccgccatgattaccactgctttcggtttcaaattaataacgtcttggcgaaaacgaactaacatttccgaggttgtctgtccgctgatcccacggtctacgaaattattctggataaagaaggtcgaatccgccggccaccatccgtctgtaatggagttccccataaataccacgttcgaaggaactttcacggtcttgttagcctccgcgtaacgaccaaactgagcccaatcccctttctcggtctgggcaaataacgtagtggtagccaataaacagcccgctaccagtaaagcttgtctcatgtttttcatattacttgattataaaatacaaaccaacgatcttgttttcatcaaacaaaagtaatcaaaattgtccactcacccattcacacaagaaaatatcttatatttgctgtcattgaaaaataaaaacatccgaatatgctgaaaaagattctttccaacacgatcgtacggttgatactggccgtcttgatcggacttctggttgggcttgtcgtaaacgagcctgtgttaaaagcggtcatgatcataaaacaaattacgggacagattattttcttcttggttccgttgatcattctaggattcgtggcaccatccatcgcccgcttaaaaagcaacgcatccaaagtcttattattcgcttttagtatcgcatacctgtcatcggttggcgccgctacctttggcgccgttgtgggttacgagttaataccgcatttgcatattcaaaccgcctcggaagatctaaaagacatccctcccatgttgtttaatctagagattccgccagtgatgagcgttatgtcggcattggtattggccgtgatgctgggactttctaccgcatgggttaaatccgaggagatggagaggttgctggaagtattccagaacatggtgcttaaattggtagaacgggtcttgatgccggtgttgccgcttttcatcgccgcgaatttctgtgtcctcagttatgagggggcgattacgaagcagttgcctatctttttatccgtcctgttgattgtcatcatttgccattacatctggttgaccttactgtatgtagtcgcatcgatttactcccggaaaaatagctggggcgtattgaaatactacggacccgcttatttgacagccttaggcaccatgtcatccgccgccaccttgggcacggccttgacctgcgccaagaaaagcaagattttgcgagaggaagtaattgacgtgactgtccccctgttcgcgaacatccatctatgcggctctatcttgacggaagtgtttttcgtattgaccgtctcacaaatattatatggaagtatgccggacttcacgaccatgctcgtatttatcatcttgcttggtttcttcgcgatcggcgctcccggcgtaccgggcggtacggtgctcgcctcattgggcttgatcatcgctattctaggtttcgacgaggcaggaacggcattattgcttacgatattcgctttgcaagacagcttcggtacggcttgcaacgtgacgggagatggtgcccttaccttaatcacggatacgttcgatcaagggcaaacggaaaaggcttccacggctttataagaacaaacttccatggtgtctttttgtagatatggttgattctttaagagtcaaccatatctacaaaaagacatatcacttccttttcattcgatactctatgggtgactccccggtatgcttcttgaaataccgtcccagataggattggctgggaaagttcaagtgattcgttatctcctgcacggtcatttccgtggtacgcaacaacacctttgtctccaatatgatatgccggtctataatggtcttcgccgactcgcccgtcacttgccgggtgatagtggagagataacggggagagatacaaagctcgttcgcatagaaagagacctctttctggtcgagataatgggcatggatgcaattgatgaacttatggaacaactcctccccacggttgcacccattttgctggcggctcgagaaggagtaccttgtcttatcatacatattaaggaagaagcattgcaactggtttttcacgatcatatcacggtacacgttatcccgatccatgtaaatcagccaaaacagccggatgatcacgtttatggtctcctcttgatcggcgggatgcgtatagcaaggattatcttttatgaagcggaaaaagggcggatccagccggaatacggcctcgtcgaacaagaccttcgaaaaggatatatattgtaccttgaaatcctcgctactcgcgttcaacgtcaggatcgtatccggtatcaatacgatcaccgtgttgcgccggatatcccatcggctcaaatcgacggatatattcgccgttcctttatagcaaaataagatcatgccatatccgctcttgtaaggacgatccaataactccctcaaatcggaatcgcctattatgaacgactctcctctctctatctcaaatggattcatatgtctactattttgcccgcaaatataagagatcattagcatataacggatcatttcatctcaaaatgaacaatcaccgcctcattgtggaaacaatgggtcgccgataagcgagtagctttgcatccgaaaatataggtattagttaagatgaaaaagcaaaatcgattgatgaagactgcgatcgccttatggtgtatcgtagctgttgggtgtaaacaaaaccctgtaatccaacaaagttcagggtatgcgacaatgactgtatccacttcggagaagactttgtccaataattactcggcgagtattcgaggaaaacaggatattgatatttatccgcaagtatccggttttattacaaagctttgcgtagcagaaggcgagagcgtaaaaaaaggacaagtcctatttattattgatcaagttccttatgaagcggccttaaacaccgccattgcgaacgtagaggccgctaaggcatctgtagcgacagcgcaactgacctacgagagtaaacaagaattgtataagaacaaagtagtttccgagttcgacctaaagaccgcctacaacacactactctcggcaaaagcccaattagcccaagcggaggcacaagaggtgaacgcccgtaacaacctttcttacacggaagtgaaaagcccctcgaacggcgtcatcggaaccctgccttatcgtgtaggcgcattagtaagcgcaagcctacccaaaccgctcaccacggtatcggacaattccgaaatgtatgtgtatttctccatgaccgagaaccagctattggccttgacccgtcaatacggctcgaaagacaaagccttggagaatatgcccgagatagagcttcaactgaacgataaatcgctttatccccaaacgggaaagatcgagacgatcagcggcattatcgatcaaaacaccggaacagtcagcttgcgtgccgcattcccgaacgaggagcaattattgaatagcgggggctccgggaatgtgatcattccggttacatacgataactgcgtcgtaattccccaagccgccacgttcgagatccaagaccgggtatttgtcttcaaggtagtggacggcaagacgcaatccgcccccgtagaagtgacccgtgtgaacggaggacaagagtatatcgtaaacgccggattgaatagcggcgacgtgatcgtagccgaaggcgtaggtttattgcgtgaaggaacaccgattgaagtaaaacaaaattaagaacaatgaaagttagcacatttatagaacgccccgtactgtccgccgtaatttccatcacgattatggttgcgggtatcatcgggcttttcaccttgcccgtagaacaatatccggatatcgcccctcctaccgttatggtcagtacgacttacttcggggcgaatgccgagaccatgcagaagagtgtcgtagcccctttggaagaggcgatcaacggcgtggaagatatgacctacatgacctccacggctaccaactccggtaccgccacgatcacgatctatttccaacaaggaaccgatccggacatggccgccgtaaacgtacagaaccgtgtatcgaaagcgaccgggcaattgccggccgaggttacccaagtgggtgtcacgacttccaagcgccagaccagtatgttacagatcttctcgctctatagcccggacggttcttatgacgagaacttcctcagtaattacatcagcatcaacctaaaaccagagatactccgtatctccggagtcggcgagttgatggttatgggtggcgattacagtatgcgtatctggatgaagcccgacgttatggcccaatacaaattgatcccctcggacgtgacctccgtgttggccgagcaaaatattgagtccgccacgggttctttaggcgagaactcggacgagacgtatcagtacaccatgaaatatagcggacgcctgcttactccggaggaattcggcgatatcgtgatccgctccaccgaggatggagaggtattgaagctaaaagagatagcggacattgagttaggaaaggagagttatgcctatatcggacaaacaaacggtaagccgggtatctcctgtatggttttccagacagccggatcgaatgccacggaggtgaataataagatcgacgcttttcttgaggaagcctcgaaagacttcccgaaaggtatcgaggtcgtaaaattgatgagtacgaatgatttcttgtacgcctcgatccatgaggttgtaaaaaccttgatagaggccattatcctcgttatccttgtggtatatgtcttcttgcaggatatccgttctacgctgattccgttggtagcgatcgtagtttccttgatcggtacgttcgcctttatgacggtcgccggatttagcatcaacttgatcactttattcgctttggtattggtgatcggtacggtggtggacgatgcgatcgttgtcgtcgaggcagtccaagctcggttcgacgttggatataagtcctcttatatggctagtatggacgcgatgaaaggattaacatccgccatcgtctctacttcattggtatttatgggcgtgtttatcccggtatcgttcatgagcggtacatccggtacattctatacgcagttcggtttgacgatggcagcggccgtaggtatctctaccgttaacgcgttaacgttaagcccggcgctttgcgctatcttattgaagccttacatcaacgaggacggcacccaaaagaataacttcgccgcacgtttccgtaaggcgttcaacgccgcattcgattcggtcatcaagaaatataagcacggggtgttgttctttatcaagcggaaatggctggcttggtctttattggcatgctccatcgtattacttatcgtcttgatgaacacgacaaaatccagtttggtgcccgatgaggatcaaggtacggtctttgtcaacgtaagtacggcctccggaagctccttggctacgactaacaagatcatgacgaatatcgagcaacggatcaaccagattccacagcttcaatcttattccaaggtttccggttatggtttgctggccggacaaggtagctctttcggtatgttcatcttgaaactaaaacattgggatgagcgcccggacaaggaagataacgtacaagccgtgatcggacaggtatatggccgtacagcagatatcaaggacgctacgatttttgccatcgccccggccatgatccccggatatggtatgggtaacgcattggaaatgcatacgcaagacaaggccggtggagacttaacgaccttctttaacacgacccagcaatatctcgccgccttgcgtgaacggcccgagatcgctacggcttactctaccttcgatatcaagtacccgcaatggcgcgtggatgtggacgcggcgaaatgcaaacgggccggaatcactccggatgctgttctatcaaccctttccggttattacggagggcaatatgtgtcgaatatcaaccgtttctcgaaggtgtataaggtgatgatacagtccgatcctaaatatcgtctggatgaggcctccttgaataatacgttcgtacgcatgtcgaacggcgagatggcaccgcttagtcagtttatcaccttgaccaaggtatacggtgccgaatctttagcccgtttcaacatgtataattcgatcgccgtcaatgccgtaccggccaatggatatagctccggggatgctatcaaggcggtaaaagagacagcggtcacttcgcttccgaaaggatatggctacgacttcggtagtatcacccgtgaggagaaccagcagagtaatacgaccattatcatcttcggtatctgtatcttgatgatttatttgatcctaagtgccttgtacgagagtttccttgttcctttcgccgtgattctttccgtaccgatgggtttgatgggtagtttcttgttcgctaagttcatgggattggagaataacatttatctgcaaaccggtttgatcatgttgatcggattgttggcgaagaccgccatcttattgacagagtacgctacccaacgccgcctgtccggtatgagcctgacttcagccgctcttagcgcggcaaaggttcgtctgcgcccgatcttgatgaccgctcttacgatgatattcggtttgctgccattgatcgtctccaacggcgtaggcgctaatggaaaccgctcgttgggaaccggtgccgttggcggtatgttgatcggtacattggctttgttatttatcgtgccttgcttattcatcacgttccaatacctgcaagagaaactacgcccgatccaattcgagcgttcccttgattggcaggtgcaagaagaggtaaaagaggccgccgaagaaagaaaagaatatttagatagcaagaaataatctatccagttgtatatatatataatgtatatgaagaataacatcatactctttgccgtagcgacgctagcgttgaatagctgcggcatttacaagaaatacgagcctgtcgccaccctcccagagaatctatatcgggaggagatagccccggcagataccttctccatcgggaatatcagttggcgggacctgttcaccgatccggccttgcaatccttgatcgaacggggattagccaataatacagatctgcggatcgcccatctaaaggtacaagaagctgaggcggcgttaatgacctcccgcctctcctacctcccgtcgctctccctagatccacagggcacgacaagtagctttgataaggcgaaagcgtcgtggacatacaacgtcccggtatcggccagttgggaggtcgatatcttcggccggctgacaaacgccaaacgacaagcgaaagccgccttgtcgcaaagccaagcgtatagccaagccgtacaaacacaactgatcgccaatatcgccaatttatattataccttattgatgctggaccggcaatacgagatcacgacagaaaccgccgtgaaatggcaagaaagccttcgtgccacccaagcattaatggcagccggcatgactaccgaggctgccgtatcgcaaaccgaggctacttgctactccatcgagacctctgttaaagatctggaacagaccatccgggagaccgagaatacgcttgccgtcttattgggagagacacctcaggatattgagcgaggaaggttggaagaccaatccttaaccccggatctggctatcggtatcccggtacagatgctctcgaaccgtccggatgtacgtagcgccgagtacgcattggcgcaagcgttctacgggacagcctccgcacgctccaatttttatccctcgctacgtcttagcggcagcgcggggtggacaaacagcgcaggtagttacatcgtaaatccgggtaaactattactatcggcggtcggctccctcacgcaaccgctatttaacaaaggagcgaatatcgcccaattgaaaatagcgaaagcgcagcaagaagaggccaagctcactttccaacaaaccgtgctcaacgccggaaaagaggtgaacgacgcacttacccaagcccagaccgcaaagggaaagatcgacttgcgtacacaccaaatcgaatcgcttgaagatgccgtccgtagcacccaattgctgatgacgcatggaaacaccacttatctggaagtgctcacggcacagcaaaccctgctcagcgcccagctctcccaagtaacggatcgttttgacgagcttcaagccaccgtaaacctctaccaagcattaggcggaggcagacattaaagatagtcctttcagacttgtatataattatgattgtaacctccttttgtgcgtgacgcatagaaggaggtaaaaaaatacccggtttatggtatatgccgtaaacaatccatccactatctttgtcatataaataaaagaatccagaaacaacaaaattcatttgtatatggcaagaatagcaagacaactgaccgaccttgtcggcaacactcccctgttggagttctctaatttcaacgcgagcaagggccttaaagcccaagtaatcggcaagctggaatatttcaacccggctggtagcgtaaaagaccgcatcgccttggcgatgatcgaggacgccgaggctaaaggcttgttgaaacccggcgctaccattatcgaaccgaccagcggtaataccggagtcggactcgcttttgtctccgcctcgaaaggttacaaattaatcctgaccatgccggataccatgagtgccgagcgtcgtaatttattgaaagcgttaggtgcccggcttgtcctcacccccggggcggaaggcatgaaaggagccatcgccaaagcagaggaactgcgtgacgcgactcccggttccatcatcctacaacaattcgagaatcccgctaacccggccgtacatatccgtacgaccgccgaagagatctggcgtgatacggatggtaaagtcgatctgtttgtagccggcgtaggaaccggaggcacggtcagcggtgtcggtgccggattgaaagctcacaacccgaacgtacaaatcgtagcggtagaacctagcgattcaccggtactttccggaggcaagcccggcccgcacaagatacagggcattggagccggctttatccccaagacctacaacggggaggtagttgacaagatcctgcaagtaacgaacgatgacgctatccgtacgagccgggaactggccgggaaggaagggttgctggtaggaatatcttccggcgccgctgtatacgccgccgtggaactagctaaacttccggagaatgagggaaaaacgatcgtggcgttgcttccggacacaggagaaaggtatctctccacggttctatatgctttcgaggaatatcctctataggcttttatcggtttatctgatgtcatagaatctgagtcgaaaacactatagtgtttgtggataaacacaatagtattcagactaaaacactactgtattcgtgcacaaatacagtagtgttttttacagattacaagagccctttcgtactcggtagctcaaaccgataaatatctcgtcggatcgccatcttgatcgagcgggccaaagccttgaagataccttctatcttatgatgctcgttcgtaccctcggcacggatattcaaattcatgcgagcagcgtcgctcaagctcttgaagaaatggaggaacatctccgtaggcatatcccctactttctcacggtggaactcagcgtcccaaaccaaccaaggacggccaccgaaatccagcgccacgctacacaagcagtcgtccatcggaaggcaatacccataacgctcgatccctcgcttatcacccagcgctttcagcatggcctcgccaagggcgatcgccgtgtcctctatcgtatgatgctcatcgacttccaagtcgccttttacccgtaccgtcaggtccgtaccggaatgcttaccgatctggtccaacatatgatcgaagaaaccaagcccggtagagatcgatgtctttccggttccatccagattccagtccacataaatatccgtctccttcgtggcacgccgtacgacagcacgacgctcgccagcaaacagatactcggtgattttatcccaatcatccgtgatataggcgggagacaatgaggtagcgtaagccgccaactcactctccgctccctcctccgggcgcaaccagatacctttagcgcccagattatgggccaactccatatccgtaaggcgatccccgatcacgaaactattctccagatcgtattcacctgtcatatatttcgtaagcattcctgtacgaggcttacgattcggggaattatcctcgggaaaggaaggatcgatcaatatatcatcaaacacgatcccctcgccttccaacgtttttagcatcaagttatgggcaggccagaaagtctccaccgggaaagagggcgtacccagcccgtcttggttggagaccatcacgaactcgaaatccaaccgctcgcaaatgaaatagaggttacgcatcaccttcgggacaaactctagtttctccaagctatccaattgataatctacgggcggctcttttacaagcgtgccgtctcgatcgataaacaacgctcttttcctcgtgctcataatttcatgtttttcatcgcgttcaataagctatcattctctttcggcgtaccgatcgtaatacgaaggcaaccccggcatttctgcacgttgctacggttacgcactacgatccctttcttcacgagcccattatacatggcatccgccttggcgacattcaccaacaagaaattagcgtccgaaggatatacttgataggaaaaaggaggctcggacaggatcttctccaaccggttacgctccgtgaggatctcgttcacttggtgcttcatggtcgcctcgtcgttcaagagctccaaagctttctcctgtgtaagctggttgacgttatacggatatttgatcttattcaagacaccgataatctccggagaggcaaatgccatacccaaacgaatacccgccgctccccacgctttcgacaaggtttgaagaacgatcagattcgggaacccggataattccttcaagaaagagggataagcggagaagtcgatataagcctcatcgatcaccacgattccttcataattcttcaatatcttatagatcgagccacgatccaggctgttgccactggggttattcggggaacataggaagatcactttagtccactcgtccgccgattccaacactcggtcagcgtccaagtcgaaattctcgtccaaagagaccttgcgacattccacgttatttacattcgcagccacctcatacataccatacgacggcgagatcgtcaccacactatccaaccccggctcgcaaaaggcacggatcaccagatcgatagcctcgtcgctgccattgcccaagaagatcgagctacgatccacgcctttcagtacggccagacgatccttcaatttccactgcaagggatcgggataacggttatacggcacattccacggattctcattcgcgtccagaaaaacggaggcatccccatgaaactcatcacgtgcggatgaatacggtttcaaattccagacattcggtcttactaaatctttcaggtctttcatatcgtgttcaatctaattgttactgcgttgcggtgagcatccagatgctcgttggccgccatggtttggatcgtgctacccaaggcacggataccatcggaagagatctcttggaaagtgatcttcttgatgaagctatccaagtttacgccgctatatgccttggcataaccgttggtcggcaaggtatgattcgtgccggaagcataatcgcctgcgctttccggagtatatggacccataaagacactgccagcgttctcgattcgctccgcgatagcggtgtaatccgatgtttggataatcaagtgctcaggagcgtattgattcgtgaagtccacgacttcccgcgaatctttcaatacgatgatacggctgtgcgctaacgatttctcggtaatctcctttcggggcaaacgatcgagttgctcttggatggcacgggccacgggttccacgatcgtttccgaagcggttacgaggaccgcttggctatccaccccatgctcggcctgcgagaggaaatcggcggcgataaaatcgggatttgctgtctcgtctgcgatcacctctacctcggatggtccggcgggcatatcgatggcgacttcttttaggcttactaattgcttcgccgccgtcacgtattgattaccggggccaaagatcttatacaccttggggaccgattccgtcccataggccatcgccgctatcgcttggattcctccagccttgaatatcttacttacgcccgcaacctccgcggcgaacaggatagcgggatgtactttcccttcccggttcggtggcgtacataatacgatctccttgcatccggcgatacgtgcgggcactgccaacatcaataccgtggaaaacaaaggcgccgttccgcccggaatatataaaccgactttctcgatcgctaccgctttctgccaacaagtgactcccggggtagtctccactttctttccctcgaaacgctgtgaggcatggaacttctcgatattcgcctttgccgtacgaatcgcctgtttcaaatcctcagtgaccaaggcgtccgcttcccgcatctcctcttccgagacttgaagggaagaaaggagcactttatcaaacttttcctcatacgcttttacggcagtgtcaccctgctcgcgtacctcgtccaataccgtacggaccgtatcgaacaaggtggttacatctaatgcgggacgtttgattagtgagctccattcctcacgtccgggatattttataatctccatattatacaatcattttctcgatcggaagcactaagataccttcagcccccaatgattttagtttaccaataatttcccagaaatgcttctcggcgatcacggattgaacagagacccattcatcgtttgccaaaggcgttatggtcgggctcttcataccgggaagcacctcgataatctcatccagcttttctttcggagcgttcagcaacacgtacttcttgccctcggcgacttgaatcgcctcgaagcggaatagaagctcatccaatatctccagtttctctttggatagattattgttagcgatcaataaagcctcacaaggaaggactacctccacttctctcaattgattgcttaccaaagtgctaccggagcttacgatatcaaagatagcgtccgccaaaccaatgcccggggcgatttccacagagccgctgattacatgaatatccgccttcacgcctctctcctctaagaaagaccgtaggatcacgggataggaagtagcgatcgtttttccctcaaaccattcagctcccttatattcctcatctttggggatagctaaggatagacggcacttactaaagcccagacgcttgatcaatttcgcctcttgccctttctccacgtactcgttctctccgacaataccaatatccgccacaccgttagccacagactgaggaatatcatcatcacgaaggaataatacctctaccggaaaaccttttgccgataataacagaatgcgtttgcccctgtttagtttaatacccgcttcttcaagcaacatcatggtctcgtcgtacagacggcccttcgattgtaccgcaattctcaacataactatatcttatttttatattataaatatcaacaaaaaaggcttaccgcaaaacggcaagcctttatctttttatcatgagtacatacataccattcagcccaccgaactatcgcccgctgtaatgatgatggtgatgtaatgtagtcgttattttcatttcttttgttatttacgtcgcaaagttacaataataattgaaagaacaaatatttctgacaaaatattatcacaatatctatattacttcaatccgttcttacgaagcaactcttctatctctttcaagcttatagattcacgctctgctttgttttcataatcatcaatgaaagaggcataatgcttccgcaaacgtttcgcttccttcttaaaggaggctaagacttctattctatattccatctctcatttcttttaagaaatctctcgctgattgtttcctcccggcaatcatgtctttcagcccggcatcaatccctgccaagatttcttccttgctaatatattccgtttcttcctcttcggcttttgtcctaattttattgttcagctttttcagatagttcttcacacggttgagcgtgtctttatcatcgatgcttaacaattcttcgaccaaatccatctttaggcattttagttccattgccgtcatacaaatactcctttctaattaattcgttctcaaggacaaagatgatgatttactttaatacaaatgactcgcttgctgcttaatcttattggaaagcatcaaggggaggtccggatgcgcggtaaaaaacgcatcaacttcttcccgagcttccttcgatgtatgggcggaaagcaaggagcgaacccaagcggtggggaaaaagatatcgccagtccgctgtacttccggcatcgcttccaaggccggacggatataagcgaccgactcttgttctcgtaggcgatggttcaaattagcgagagcggaagaggcccatggctccaccctacgattcccggcgatcaacaaggacgcgaagacactgtcacgttccgccttgcggggcgatacggatggggagataaattgatactccttcttccggtccggattctgtatgcgggataattgcgtagcgataatcttatccgctttttccggcaaatgcatcgccagcatataggataagccaatataatcactctcgctcaacgtacaatctttcggagctttccgttcctgccataacgtatacagacgttgtaccgcctcctctgaatccgctatcgaacgatacaaacgaaacgcctgcaaacgatgttgggatacgggattcgttgtcacgatcttccacaagacctgttccaacggacgagaatccgacgggaatatccgctggcaatctcctaaatagcttaaagccatcgagaacaataaagaattagactcattcggtaaatacgctaacatctcttcacggaacccttgcggagaaatcgttttccaacgaagattctcataaagggtaatcagcaaagatcccttcaacacctcatcttccgatgagcgaagcacagaccatagaccggaagactccccctctgttattttaaagaagccataaccacgcccatttatattcggaagaatgacacaatttccattcggaagaaaacttaatttcattcggaaggaatcagagtttccttcgagagaaaccgggatttcttccgaatccgttccacagatcacccgataggttaattcttgcggccattttaaaccccggcccaacggatcacgctgctctacgatcaactctccatccttaaccgaagccgtaatctccggcatacccttctgattcacccacacctcgctccaagcgaccagatcctcttccgtatatttattcaagatacggatcaagccctcccacgtagcgttcccatacgcataagtagtcaagtactcacggattccctgcaggaaagcctcttctcccagaacacgtaccaacatttccataaccacgggagatttatcatagatgatattaccatataccaaaccggcgttccgcaaattatccaaatcttgcttgatcggattcgcacctgacgtacggtcttccgaataagatgcgggaatataatcccgaataaaattcaaccggtgattcacgtccggatataaaggttctacgatacgggaagcaaaataattagcgaaaacctctttagtccatacatcatcaaaccatttcatcgttacataatcgccaaaccacatatgagaggtttcatgcgcgatcaaggcactccgactcaatcgctcatttaaggtaggatgctcatccagaaacatccggcgatccgtatataaagtagcacccgtatgttccatacccccatattggaaaccgggtaagataatcacgtcatatttagcgaaaggataaggaataccagtaaagtcttcctgccattccaacgcatcgaacacctcgtcggcgatggctgggcattgagcgatctttttcggatccgtctcccgatgataaatagagatatcccgcccgttccgggaataaacctcccgagtcagtttaccggccacgaatgagaacaggtaggtactaagcggttccgtctccttgaaagaaatacgattccgaccggagacgctcgtactatccgtttgtgtgatagcgccattcgccacggcctgccaagtggaaggaacttccaaggtcaaggtaaaaaacgacttcatatccggctggtcaaaacaagggaataccgtacgtgcccggtccggaaccaataacgtatacaggaactcatcccgtcgattcaaggattgatccgccggagtaaaagtgatcgctacccggttctctcccaccgctacccaatctgaggcaatcacgatatgctcatctttcacttcatagggaatatctcctccgttcaaggttacggaggtcacttgctccggttctccgcggaaatcaataataagcggctgtttctcgtctaatcgcaaggatagctccacttttccccggatcgcctcgtcacgagattccgggatcgagaagaaaagattataacggacatttgagaaatgctccttccggaattgagctagctcaaggctcacaccgggccgggacaaaccggcctcatcttgtttaacagagctacaagcaaccagaccggacagtacgcaagctccgataaatacctttagattcatatctcgtaattattctcttaagtattctgctatacccataaaatttcgttccaacaaatacatctggctagccataaaagtgaaaaaatctccccaatgcgctctccgatgcaaatccaatccttcctttgccacatagatacgggccacttgtcggccattctcacggacaaagcaaatatcccagatcaagccttcgggaaaatcctgctccaaggtctctttataccaagtcaggcgctcaaacatttccagacgtaaatcctcgctacggtggtttacctcaagaataacgtaagccccttggcggttcgcatcgaatttcaactcaacgccctttaccttcgtatcatataatgtccaaattttcttacgcccccgcaaatagggttgcacctcacaaaaagcggcgaagctttcccaaaactccaatttgagattcttcagttcctccttactatacattatttataaatgtctttccttgttaccttaacgatctgtccgaatttggagagtttctccatatccatactctttgaattaccgactatcgcatatatcattaaatgatcttgtatattctccttataaaaacgaaggatatcctccatagtcatccgatcgatgacctccagataatccttgttcggatcgctctcgtacccttcacgccggaaaccggcgatcttcaaggaaagagagcgactagtaggatattcattattcacccaattacgaatcgtctgcttcaccgactccacccgttccggacgttccggcatatcatgcaccagattttccagcacttccatcgcatcgatcatcttatccgtctgtgtagccaatttcatcacgaaactagcgggcttctccgatcgattcaaaggaggatgtttcaaacgggcatttacttgataagcgaacgaacgaaactcacggatctcctgaaacatcaaggatgacatatcccctccgaaataagcgctaaacaaccgggaaacaggacgatcttccttagccttcaacggatcgatatacatataggcatagattatgctttgcgcgacatcctccatgtccatgaaaaagacagtcggcttatcatacgtcataagatcacgaatatagggagagttcgatggaatacttacctcctccaagggtaaatgcagcttgatctgccgagcggcctcctccgtagacaatgtaccacaataatgcaggttacaagcgaccgaacgtaccttactgaaggtgtccagcaacatctttccttttagttttttgatttcagcgaacgataatttggtcaaataacgggattgctccccaaatttgactttctctaacagcatatcggctacgttctcgctggaattgaacaacgatttctccgttaccttcgcctcgtccacaatctgccgtaacttcttgtcatctggcttggcgtgccgcaagaaatcgccgaccaaagccattgtttgggtaaaatgcccatcgaaaccattcaccaccaccagaaactcagaatccgtggaatcaaaagtcaatgtactaccaagttcctgcaatttaccccgaaagacctcaaaagacatcgattccgtcgctacgaaaggtagataagcggacaatttatcaagatcacgaagctccaactgccccactccataagatagtgtcagcgagaatatatcatttacggaattatgagtcttatacaacgtgacaagcggacgcaaggatacgacctcggcgtctttctcaaaatcgagaaaatgcggtttcaattcttgtacgggtatcttttccagacgttccacataagcggaggaagcatcggagttcttcggtataatcggtgaataatccggcttgggtaagatcgtttttggatagcgtccggtcttcttcgtgacgtacatataattctccgtaaaatatttcttggcgacctcaatcacgtcttctctcgacaaggcatcgatacgagtgacctcatccaaataatcctgccagcttttcccttgagagaaaatacgcatcatcacctcggcccttgagtttatgtcttccaatttggaggcatattcacgtttctgttccaatttcaagctttggaacatctcatcgctaaaatccccctccttaatacggttgatttgtttccatactaatttctcggctgccgcataggtctggaaaaagaacttcggaaataccaacaagcctaatattccagcctcattcatactttggttaaccgccatcgcacccatcaccttatgatctaccgtcagcttatccaaaaatcccgtaccattggagttattcaataaagatacggcgatattgagcgcaacttgatccggatgattcgcgggaactccccggaatcccaatgccataattttcacgaaaggcataggaatacgtacgctcactttctcccgcccctcgaatggtggaagcgcaacgatatcccggtggggcggcttcccttttcgtatccgtgaaaaagtagattccaagattggcaagacctcctccgtatcgaaatccccgcttaagatcaatcccatattggaagcgacatagtatttctcgaagaaccggcgcatctccgaaagacggggattcttcaagttctccgcacttccgataatcggatacgcatacggatgcggatagaaataacgctctgtcaatttctcgatggcgacgctagccattgtgtccccatacatgttcttttcctcatagaccgtctccagctcactctggaaaagacgaaatacgggatttaccaaacgctcactattgatctcggcccattgggagatatattgcggagagaatgtattgaaatataatgtatagtcgtaagaagtcccggcattcaacttcgtaccaccgaaacgagagatcaaccggtcgaactcgttcggtattacatactcagcggcacgtacgctcaggtcgttaatgatttgctgcaaatgggcacgcatcttgggatcctcggtatccgccaaagcgtcatatttctcggcgataatgtccagcaagactttctcggactcataatcgattgtcccgatcttatccgttcctttaaacatcatatgctcgaaataatgcgcgatacctgtgttaggggaatctttagctccggcttttacaactacggctccgaatatcttaggttggctatggtcctcattcaaccataccgtcaaatcattacttaatttatgctctcgtacctgtagaaaatctgaggttgacaacagagatctcatggaatccatttaagtttatattatttcacaaagatacatttttcaattggattaatacgcttacatttacaagcaatcttaacaaaagggcaaatttaacgtaggattgaacctatttttaagagtagtgttatatcaaaaaacgattattatgataaatttaggtagttggatgaacaaagtcctcaccggatggggtgtagacgagaaaatagcgaacacatttgacgaggcgatcatcgccatcttactagtggcggtcgctatcggattagattatttatgccaagctatttttgtcggaggggtacgtagtatcgttaagcatacgcattataaatgggatacgttattaattaaacgtaaggtcgtacattatctcgtacatacgattcccggcattttagtatatgctttgctcccgatggcttttatccgaggaaaggaattattattcatttcccagaagatttgtgcggtctatatcatattttccctgctgttagcgctcaacggtcttctcttaatgatgttggatttgtttaaccaacaggagaaaatgagaaacaggccgatgaaaggttttatacaagtattacaagtgcttgttttcttcgttggcggcattgtcattatagcgattctcgtcaataaatccccggctacccttttcgccggattaggtgcgtcggcagctattcttatgttggtatttaaagatagcatattaggtttcgtggcgggtatacagctttcggcgaatgatatgttgcgccccggcgactggatcacgatgccttctgccaacgcgaacggtattgttcaagaaataaccctaaacaccgtgaaagttcagaacttcgataatacgatctcaacaatcccgccttataatctagtgaatagttctttccaaaactggcgcgggatggttgagtctggaggacgtagggtcatgaagtccatttatctcgatttgaatacgatcaagttctgtacaccggaaatgctagatacattccgcaaggaaattcctttattagcggattaccaaccggataaggatgtagtacctacaaactcccaagtattccgtgtatatgtagagcgttatctgacaagtcttcctgtcgtaaatcaagatttggatttaattatcagccaacttcaatccacggaatatggtgttcccgtccagatttatttcttctcccggaataaaatatggaaagaatatgaacggatccagtcggatatattcgaccatttcttcgctatgattcctaaatttgaattgaaagtatatcaatattcagactaaagtacgtgttcggattatttttcctatcttcgtctccggattgtctacttaaagtttaaaatcgtatttatgagcaagatacaagaatgggtatataatttattagttcaaatggggttgataagcgaaaattccagttacctagacaatatagtgatcttattacttattatagccgtcaccgttgggatcgattatagttgccggtatattttccttggtatgttcaaacgattagcgaggaagacgaaaaatcaactggacgatttaatcgtggatcgtaagatcatcaataagatgatgcatatgatcccggccatattgatttatatattgttaccattcgccttctcagccgaagagacaccgaagattttaatattgctccaaaaactttgtcagatttatatcatagcggtttctttaaggtttataaacgcttccttaaatctgatccacgagatctataataaaaaagattcctttaagaacaagccgttaaaaggcttcatacagatcttgcaggttacggttttctttattggagtgatattgattatcagtattcttatcaataaatccccggtttctttactggccggattgggtgcgtctgccgctatcttgatgttggtctttaaggatacgatcttaggtttcgttgccggcatccaattatccgccaatgatatgctccgggccggggactggatcacgatgagtaaatatggtgcggacggcacggttatcgaggtgacattgaacgccgtgaaagtaagaaactttgacaataccattacgaccatccctccttacgccttagtaagcgacgctttccaaaactggagaggtatgagcgaatccccgggccgccgtatcaagcgctctatcaatatcgatatgaacagcgtacatttttgtaccccggaaatgctagagaaatttcgtaagatctctcttatcacggattacatcgacggaaaagaacaggaattatatgaatacaatgaagaacatcatatcgatagctccatttgggtgaacggacgtagacaaacaaatctgggtgtcttccgtgcttatctcgtacgttacctaagaagcctcccggaagtaagtaaggaattagtctgcatggtaaggcatctacaaccgactgatacaggtattcccatcgaactttattgcttctcatctaataaggtatgggtcgaatatgaaggaatccaagcggatatattcgaccatgtacttgcggtaataccggagttcggactaagcgtattccaaaatgtatccggggcggatttgaagaatatcatcatcaaacttcccgccggctcacaaccctcagagtgtttctagaaactcatgtacatgtttttccggaaatgataggaacacactaagatgtcaaaaaaatatcttaggtgcatcggccgacgatcctaagatacttcgccagtgaacctaagatacttcagtaatgaacctaagatactttgcctatgaaatcagtatcggcgtagccttacggcactagtggtgtagggttgtgcctatactggcatgaggctatgccgatatatgtatttgtccccttagaattggaaataaataaacggctgcactcccgcactcttaaactgaacaacaatgaaaatcgctatcgccaatatagcggcctgtatcaataaaggggaacgagtcacgatttccctcaagacatcctcagagcgtttaggcataaaatgcagtacataaccgattaccatcaacgcaaacacccctttatatcctgagacgaattgcatgaacacctccggatgaaaattcgtgaagatctggcgaagcatctctcccacggccttcatcgaggtagcccggaacaagatccatccgaaacaaaccacatggaaagtaatcaggacacctaatacccgtcgccaaggcttcatctcgcatcctaaggccttaaagctactgaaatgccccatgatgaacttatgcgcagccaaagctataccatgtaaggctccccataagatgaaactaatggaagccccatgccataacccgcctagcagcatcgttatcatcagattcatataggtacgaatcttccccttccggttcccccctaaggatatatacagataatcttttaaccaagaggaaagggaaatatgccaacgacgccaaaactcggtaatcgtagccgattggtagggagagtcgaagtttatattaaagcggaatcccaacaacagagcgataccgatcgccatatccgaataacccgagaagtcacaataaatctgtagcgcatacccatagacacccaacagattctccacacccgtataaagcaacggagcgtcaaaaatacgatctacgaaattcatactgatataatccgagataaccgttttcttgaaaagaccacataagataaggaacaatccctcaccaaactcagatcgcatcaccgtaggattcttatacatttgagggataaaatcccgggcacgaacgattggcccggcaaccagttgaggaaagaacgatacatagaaaacataatcgatccaacggccgagaggttggattcgtccccgataaacatctatcacatagcttatactctggaaggtaaagaaagagattcctaccggaaggaagatgttcatcttaagccattctcccccggcggccatagtaaacagttcgcctaggaaattgaaatacttgaaataccccagcatacctaggtttatgcaaagactaagcgtaacgaataatttacgttttaataccgatgtcgtatgcgagatacattgcgctatcaagaaatcggaagtagccgtaaataccagcagcccgaaccaaagtccactacttttataatagaaataaagggaaaacagtgtcacgtaaataatgcgagccaacgtatgtttccttagcgacatataaatcatcaggaaaccgataaataagaagaagaacaacccgctactaaacaagatcggggcattatgatgatacgtcaggatatctcccagtttctcccacgtgaattgatgattactaagccaatctctaagtatattatattccatataagattcttatcggttattatatgattccatgaacgccctaaacaaaagcgttccttgttcttgatacccttctttcgtaaagtgaatccgatcccgtcccatcaaacgagaactatgccatttgcggcacgagtttttccctcctgtcgtagtgaataaatcccagcaagcgacctcttctttcttcgctacattccggatagcacgggcagcccgctcggtattatcattacgcacatacgttcgctgcttattgactcgcacccttttgtaacattccggaggagtcgtcagtaagatcgccgtattcggcagctccttcttgacgatcgccaagaaagcctctatctggccggaaaactcatcggtattaaaacgtctgccgaatgtctcgttggttcccatagagatgattagtaaggacggttttaataaagccaactgacgtatataagcctcgtccgtataattcacatacatcgccccattcactccgatggaatggtataagatacccctgcctccattcttcagtgtcaggccataatataaattcgtaaaggatgaggccggtcgcaatgtattcgtgccctctttccgtctcgtactctgcaattgtagagtatcggtcaagcaggagatccggaaagtgtcggctaatacaccaggaacacatacggtatccgcacggaatgtttggaccgagtctttcaaagccccggcaggaagcatgggcatcgacttctcccctctatataaaatcgcctcattaaactcgtatccggcaccattattcggagttatcacgacatcaaaattaatcgagggggaaacagacttaatcccgatcccaccgatccctatcggggttttccggacatgctgaatacaacgtccggcaatccaatccttagcgacggatttgataaagtaatcatccggctcgttggtcttgctcaacttaaaaggagcgatccagcctcgtccggcattcccgaacgcctgttggaaaaggcgcatgacacgaccgcttaaatgtccggcttggatatgcgaatcccccaactgaacgatcgtgatagccgtatctttccctgcacgcaacgaatccagttcattgaaaaaattattccacgccttactagaatccggtaagatcaacgtatcttttcccactttcatagaataagataaaggaggcaacgctacagtatcccgaaccgccaaactatcaagagatacatccccgtttattccggctttaggtttcggaacagagaagcccatgatcactcctaaaacaaccagactaattaaccactttctccgcttcatcataaaaatctttttctgataataacgctttcagcaaggcatcggcaatctcccgtccacccctaaagcttaaatgcgtataatccttactagcccagtttaattctacgaaacggaccatactgttctctcctcccatagcaccgaatacattccagaaaggaacccctgcctttttagcggcttgcctttgcgcatgcagcaaggctaacacggccggcatcgtctcgaattccccatcgtcttgacggcttctgtccgacacccccaacatcaatatatcagcttccggaaaacaaagttgtatatggttaatgacctttaccatccggctactataccatccataattcatcacgctatcgctcacgacattcaacccatactgcaagacaatcaagtcatacggacggatcttattcaatgcttggcaacgggagacatccaatcgctccaatatcatacccgagtttccccgaagagagaaattatcgaccacgacacctaaatgatcctccatagcgacccctaatgcccggaactcaggagtattcttaaaagtgaaatccgcttcggtgaacatcccttccaactcgtattgggttacgatcgatgtggcgggaagcatctcttgtagggtatcggcggaagcgttgcaaaccaagcgcatctccgtattcttattctgctcataaatcagtttcaaagaagagaacgtctgaagctccggataacgcttagtcgtcttcacatggatggaggcgttttcctcgtttgcctcgaacatcatcccagataaagtatatccatgctcatgatctgtcagcatagaccaagtagtccatccggaggcacgttgctccacggttggacggaactgtgccgctacggatgtgaccggtacaaaaccaacaccccgccccccaaattccttctgcatcccggaacggaaatcggccaccataatatctccttcgataaaagaatctccaaggaaggccacacgtaccggacgattcaattcccgcctgttttttaaggcggcgaagaatcgttgcaaaccgatatgtccaagagaatagtcctcgatatgagcccccagcgaatccgccccttgaacagcatagaccgctttgtataacgaatcacgaagggccaaagccgctgaatctattccggcggaacgcatgatagaatcccttaatgctaccgaatctacttgaagggtgtccgcttgttccaattgttgtttcaaagaatccaaggagagcttttcctctttcaccttgaaatccgataaaagatctacctttttgatcttatacccgaacaatgtatccggaaggctatataaaccaaagctcatcaacaacgtcagcgacagtaacgctaacactctacccaaattattatctttgttcatctaacttttgcttataaggggacaaagatagacaagtttacctacccggaaataatcttcggacaaaaaataaccttaaattatccgttcagggtggatcatcccttaaacgtaagttgagacaaaaagagatgcaataacgaaggctccagcagcattgggaaaatcaatccataaatagccccgtagaaatgggcattatgatttatgttatctcctgtttgtttcgccatatactggcaataggccagatatagcaagccgaatacgattccggggacaggcagtacggcgaaaaacaagatctttccccaaggatcaaggaatatagaggtaaatagaaccgccgataccgctccagacgcaccgatagagacataatacggatcattacgtcgttttatcaaatcataaagcgaagctacgatcattcccccgaaataaagagccagataagccccactgccgaatcccatatatcgaaacgttcgttcaatatagagaccaaatgaccagaacgtgaacacattcactagcaaatgtgtcatatccgcatggataaatccatgtgtcacgatacgataatattcatgattccggatcgtacgatatgggataaacgctaatttcataaataactccctattactaaaacagataaaagagagaatcactgttattccaataattaaataagtaatcatatattctattatttttctgatgagccacaaagcaaagcataaattccggtttatacaaatatcaggtatatattatctaagccaaaggaaaaacaagaatccccaaagaaaaacagataacagtaaaaccaaaggcttcaaaactttatcgcaaaaatagctccttactttctttcgatcaggaatattttccactgcgataacacgattcaccttattcgtcctatcaaaataggaagaatatagaatcaatatataaaaaccgaatatttgcaaaagaaataggatggagactaatggcttttcatatcttttctgtttctcttctattttgaattgctttaaatcaatctcttttataacccgaatcaatgttttcttttcttccaatattaaagaatctagattctctgaaaaagaagaatctagactttttaaattctcatagtaccggaccatactatcaattctatttctttctgtattcaaagaactcaatttcatactttcagcagtcatatctatatatgatatagaaaaagggaaaagtaagaaagctaaagacaacacattaccactaataacaacaaatgttttattcaagcctctgtttagttccttccaaaaaatatttgtcaaaaaaaacacactaagctgtataatacaagcaatacataaagtacgtatggtataccccactaattgcagccaattctccatcgcttctacatctacagtaataccaaagagggtcaccgcataaatcaatgttataaccatcattaatctatgttctttctttaatccaagtaccagatcaaacattctttcccacatactatccttatattttttcgccaaagatacaaagattgctttaagcacatggtatataataaaaaagtggataagccttttctcatatccacttttttatttgttacttgaataagaagctacttcttgctatcgattaccaataacggagtatcggtgtggaataacatttttctcgcgatcgaaggattgaacattcgggctaggatattacggcgatatgtgcttagggctataacatcaatttgtttatcacgaacaaatttctcgatggctaacagcaagtcaccatcggcaagcaccgtatgggaaatatgggcatgtggatattgtttcttgaaatattcacggacgcctgtcaaacgaatctcaccaaggtgggactcgaggatgcctctatcaccgtgagcgacttaaagagcggttcttccatcatcccatcctccgctatcacgacgaactttgtccgttacgtcatgaccgatgagttgaataaagaccgtaaaggcggttgcggccaccgagagaataaggcggaatgggattcctccgtcgtagccgatgtattggatatcgtaaagatccgtgatatcaaggcacgcaccacccagccgatctggatgaatatctgggtacctcaatccgcgaaagccggtaaatataaagggacattgaccgtcacgggaaaaaatgcctcccccatggaattacaaatagaagtggacgtattgaaccgcacacttcccgccccgaaggactgggctttccatctggacttatggcagaacccgtattccgtggcccgttactaccaagttcctctttggagtaaagagcatttcgacgctatgcgcccgatcatgaagatgttggcgaacgccggacagcgcgctatcaccaccagtatcatgcataaaccttgggccggacagaccgaggatcatttcgacagcatgatcacccggatcaagaagatagacggcacttgggcatatgattacgccgtcttcgacaaatgggtggaattcatgatgaacgagatcggtatcgatgatatgatcagttgctacaccatgatcccttgggctttatctttcgattattacgacgaggcgacaaatcgtgtacaatttctcaacacgaaaccgggtgacgccgcttacgcagactattggggtactttcctaaaagatttctcccgccaccttcgcgagaaaggctggttcgagaaaaccgccatctctatggacgagcgtccgatggaggcgatgcgtgaggcgatcaaggttatcaagcaagccgatccggagttcaagatcacgctggccggaaattatcatccggaaattcaatcggacttatactatttaagtattccctatgggcataaattcccagaagacgtaaaggctgcccgtgataaagcgggacagatcagtaccgtttatacctgttgcgcggaagcgttcccgaataccttcaccttctccgacccggcggaagcggcatggacggtcttgcacgccgtagccggtggttacgacggttatctacgttgggcagttaatagctggaccaccgatcctctgcgtgactcgcgtttccgcacttgggcggcaggcgatacatacagtatttatcccggtccacgcagtagcattcgcttcgaacgtttggtcgagggtatacaagattgcgagaagatccgcatcctccgggaagagctgacaacgaaaggagctaaaggcaaactcgagaagttgaacaagacggttgccaagatcactccggaaggtttatccgagacacaagaatccgctacgcagatggttaatgagattcataaacttctgaatacattataaatagtaccggacgccgactgcgcagtcggcgtcccctaaatatatcatcaaacccctacaatgtttgatattcatcaaaaaacgaaatccctacctccgatacctttctttttctttgtccgcctcgattccttcgcctatttttggggcactgaaaaacacaaaaaccattctatatgaacaaactattaatgggcgcatgccttacgatggccatgcaagtagggcactcccaaaccttgccgcaattgggtaaagatcctatcgagaaaatcgtagccgccatgactgccgaagagaaagtatccctgttagtcggaaccggaatgcccgggttcggcggccaatcagccgtagtcggcagcacgcaaaatatagtgccgggagccgccggaacgaccttcccgatcgaacgtctgggaatccccgctatcgtagtggccgacggtcccgccggattacgtatctccccgactcgcgaggggaacgaggcgacctattattgcacggcattcccggtcgctaccttgctagcctccacatggaacaccgcattggtcaaaaacgtaggcaacgccatgggcgacgaggtgaaagaatacggttgcgacgtactcttggcccccgcgctgaatatccaccgaagccctctctgcggacgtaacttcgagtattattccgaagatccctacttgacgggccggatagcgacagcgatggtaaacggtatccaaagcaatggcgtgggaacctccatcaagcatttcgccgtcaataatcaagagaccaaccggacaggaacggatgcccgcctcacccctcgtgccttgcgggagatttacctaagaggtttcgagatggtcgtaaaagaggcaagcccgtggacggtcatgtcttcctacaataagataaatggtgagtatgcctccgaaagccgtgatttattaacgaccatcctccgtgacgaatggggctttagcggccttgtcatgaccgactggtttggcggcaagaacgcccccgcccagatccacgccggaaacgatctgctgatgcccggacggacggaccagaaagaggccctcctaaaagcgcttgaggacggttctctctctatcgacgacgtggatacggacgtaacccgtgtattacgactgatccttcaagccccccgctttgcccaatacgcctattccgacaaaccggacctgaaagctcacgccgaggtaacccgtgcgtccgcttccgaaggtatggttttattaaagaatacgaacaatgccttgccgctggccccgggtatcaagaagatagcggcttacggtaccacctcgtacgattttatcgccggaggcaccggcagcggcgatgtgaacgaggcttataccgtatccctcgtggaaggtctggagaacgccggttataccatggacgccgaagtgaaagccttatacgagaaatacagtaccgaggaaaaggcgaaacagccgaaagacacgagtcccgccgccgctttcttcaaccaccctcgtatcccggagttcgtaccggatgccgcagggctggccgctaaggcgaaagaggcggatatcgccttcgttacgataggccgtagctcgggagagttccaagaccggaagatcgagggagatttcaacctgacggaggatgagcgagcgttgatccaatcggtttccgacgctttccataaggaagggaagaaggtggtcgtaatcttgaatatcgggggcgtgatcgagaccgccagctggaaatcggaaccggacgccatcctattggcttggcaagccgggcaggaagggggtaacacggtagccgatatcctgtccggaaaggtgaatccttccggtaagctcccgatgactttccccgtgagcttcgccgacgtagcctccacgaagaatttcccggacgcttcgggtatcgacctgaaagaaatgttagccggtttcatgggaggaggcccggagcatacggatcgtaagaatattgactataccaactacgaggagggtatctacgtgggctaccgttacttcgacacgttcggcgtgcccgtctcctatccgtttggctacggacagtcgtatacgactttcaattattcgagcttgaaagtgttcatgggtgatacggactacagcatcagttgcacgatcacgaacaatggcccggtagccgggaaggaagtggtccagctatatatctccgcccccggcaagagcatggataaaccggcgaaagagttgagaggtttcgccaagacccaactcctccagccgggcgagagccgtgagatcatcttcaaggtgaaagatacggatctggcctccttcgacgagagcgccagtcattgggtcgtagagtccggtaaatatgaggcacagatcagttcctccgccgccgacatccgcctaagggattccttcaacgtgaaggggcgggtaacggagaaggttcatgcggtactgttacccggcgagaggatcgatcttctgaaaagataagcccggaggtatctacctagttatcgggagagcggggtatcaacctcgccctctacttattaatcacccggctgttccggctctaagaaagtaaggtaggtctccacacgcccctccagcttcgcctccatggtcccttgctccgacacgaagagatatttgtcctttttctcttcctcggtccatgtatcgggagtgtagggagcgatcttccggtcgccggcagtcctcatgaaatagatagcgggcagaaggccgttcagttggatctggttcgggtcgatatagcgttcctcgtattgtcgcgagaaacgcgagctcaccctctccagccggaagcggtcgagattattcataaacaggtaatccgtgccttcatctcccggcagggaggtgtagatcatagatgagactttcacggtaccggccggtgtcgtgtacaaataatagaaatatacagtccatgtattcttggagcgggtttgaagggtatgtgtctcctgcaaggaatgcaaggcccaaaatcccgggggtgtgcatctcaccctttgtacgaatttatccttcgcgatttccactcttccccggatctccagaaagtccttataggccactgcctctatttcctcgtttgtcattgatggcgtaaacatgattatttttaatttttaaggtaaagagacataaaggtacgattataaatggggattccaagggtttcaaggaaatgtggatgaaagaaagacaaaaaagagaggcgaactcgtacccttatcttttttattccatatattcgtgatgaaaattccctaagacccatttaaaagagagatagcgtgactcccgattttctttggacgcttatcatgaaccatatcccggtgctgaagggtgcatgatagggatattggaaaaataaaatatatggaactataaaaccttctccatttcatacgataagattcaatggagaaggttttcggactatatagggcattcaaggaaagacttcgcctgtttctatatcaacggaaaacctcacctgtttcttattgccttcataataaagtatatcacatttatattcccaaagatttccgcttttattttctatagaaaccgtcaattgtgcattcctttgcatattttccttcaaaatccgaataggagaaatccacttagactccgatctgcttaaatcaaaacgagataaatcccaatcgcggctaagaaaaattgcttcctcataggagatcgattcataatttaccgaagccaatttttcatataagcgtgaactataaaattcctttatatcctttcctgtcgaagaaactaccaaacaagagtccgtatacgtattataaaatagaattgactcatcataccacttataaaaacgaatatctgagtatggatcagagtccgtctcctcatatctatttatgccattttgatcgttcaatatcaacacatctttttttatctcttgatttcttgatagaaaagctaaattggctacatagccccaacgcatagtcaatatatcctccaaacgaacaaggtcaacctcatacgtcttatatcctccatagccttcatggatcgtaaggttcaagtcgatcgaagtatcaccactccaagaatcagttatcccactctcctcatcacatacatatattttcagttttttatctttcaatccagtaaagaaataagagtttttatcttttacgaccgtagcctgcgatgcctttactcccccattgaagtacaaatagccatattgctttcctcccggattatcatagaatgtaaataaaagtttatctccataagtttcccatctaaaatcaaaaacactagctttatcaaagtcatctttaaaatgatggatcaattcaatagaaccatctattaaatagagcaaaaaacttgttatgcctgatgtttgagatacttccctcgtattataaacatgaacaaagaaaatatatcctgtattcaccttgacaatatgacaaatcttaagtcctttggtttcctttggcaattcaaaagaagaattccattccccgattaaccccgtgaaatcattgccaaacagccccatccacagcttctcgtttttaacataagctagccatgtcccctctttacagaaagactccttatcaaatcccgccgtatcctttaagaaagggagaatcttctcaaactggtaatcccacggagttcctgcggaaggtaataatggctcctcattttctactatatcctcttgctctccacaagaaacacaaaacacaaaaaagaaaaacacccacaaatatttcaccattataataaaaaattatcccctcccgtgcctcctccggtcgtcggttaacaaataaaagaagcgtggagaccattgtctatcactgtactgaggctctggactgcccttacccaataataagacaatgatcccacgccttatgcaggtatataatctatccatgaatgggtaggtatataacagataaagcgcaggagccattttcctattatcttgggtaatgaaattgtccagattccagtacaagataatatcgaaacgcttctacgttatttttccaatacgtcgcgaagatcgtgtttttttaaaacattcgcaaaacaatcagattcttaatgtctcttagccctaagaaatgccctcgaagggtgaaaaatgacttcttagggctaaaagatagtttttcaaccgtgaaaagtgatttccttggcctaggaagggactttcaaggccgcgaaaccatttcttaggcctaaaaagcctattttcacccttgaaaagccatttcttaggcctaagatgattattcgcgccattcaatccccattttttagacctaagaagcccttattcagcaaatatccctaacttagagaagtttttaaactctaaatcaaatttaccatgagtacttacacaaaaatcaagacacttccgctctctcttttcaacaacgccgagtacctctccttcatgaaccacgtcctcgacctagccaacgggaatagcggtggcggcgattccgagtcccccgacgagatctccctgctgaccggcagcgacggcatccccgagctgggcctcaccaaggaattcctcgatacctacgaggcagacctcctcgccatggccgacgtggtggacgagagccgcacctcgcaggagaccgagcaaatggccttgcacgataccaaccgcgacaacctcgccatctatatcatcacccgcatctcacgggccggtaccctcccgctggaagccgagcgtgacgcgggcaagtacctatacaaggtcatcaagccttataacggcatcgcccgcctccccatggcgcaggagaccgccaagataaagggcctcttgctggatttgcgcaaggacgagaacaagccgtacgtcaccacgctcggcctcgacgcttacctcgccgaactggagaaagagaataacgcctacgaccgcctgtcgcagcaacgcgtccaaaaccggaccacctccaaaaaggaaagcggcgccaacctgcgcaagcggatcgacgtgtattatgacgatctcaccctgctggcccagtcctatggcgtagcgaagccgtccgagaaagcgaccgccttcatcgccgccctcaaccagctgatcgccgagaccaccgccgcctacaaccagcgcatggcctccgccaagaaaccggcgcccgctcccgagcctacacccgagcctacgcccggcggagactccgagagcccggacgagatctaaccgtcacgtccctccctcccgacgcggaagcgggaaataaaaagagaaggaaaacaattccccttctctttttattccgtatattcgcgaaggaaattcctaaaacagagcgatatggagacaacgacatcattaaagacattcgaggtaaccatccccgagaaatacgccgacatcttgaagaaattcatcacctcgctggaaggcaaggtgaaggcacagaagaaatccggattggacgaggccttggaggacgtgaaggcaggaaggatttatcatgcggaaagcacaaaggatttgatgaaacaaatcctaggctgatgaaatattccatcaactataccaaaaagttcaagaagaacttgaggctatgccaaaaaagaggatatgatatgaacttattcgagcaagtatccaacttgcttgaaacaaccggttcccttccctcccaataccacccgcataagctatccgggaaatacgcgggattgtgggaatgtcatatccaaggagactggctgctgatatggagccaagacgacacggagctaatcttgcttttcaccgataccggaacgcattccgacctattctaaatagaaaaagccgcctccccattacaggaagcggcttttttgtatctagtatttacttttcccggataaatatattaatcggcgtaccggtgaaatcccagttctcgcggatcttgttctcaaggaaacgtttgtacgggtccttgatccattgcggcaagttacagaagaacacgaaagaaggcacgctgcccgccggaagctgggtgatatatttgatcttgatatatttacccttccaggctgggggaggataattctcgatgatcgggagcatcacctcgttcagcttggccgtagggacacgcttggagcgattctcgtaaacctccttggcggtctccagcaccttcaagatacgttgtttcgtcatggccgagataaacaagatcgggaagtcggtaaacggagccagacgctcgcggatagcggtcgtgtacgagtcgatcaccttctggctcttatcctcgaccaagtcccacttattcacgcaaaccaccaatcccttcttattcttctgcaccagcgagaagatattcatatcctggctctcgatgcccctcgtagcgtccaacatcagcacgcagacatccgagttctcgatcgcgcggatcgaacggatcaccgagtaatactccaagtcctcattcaccttccccttcttacggatacccgccgtatccaccaaatagaagttcaagccgaatttattatatttcgtgtagatggaatcacgggtcgtgcccgcgatatcggtaacgatatgccgatcctcgccaataaaagcattgataagagaagactttcccgcgttcgggcgtcctataatcgcaatacggggcaactcctcctccagtatctccaccttctcctcgggcaacgtcgccacgatcttatccagcaaatccccggtataagaaccattgatggccgagatgcagaaaggatctcccaagccaaacgagtaaaactccgccgaggccggatgcaattcgtaattatccgccttgttcgccaccacgatcaccggccgcttgcaacgacgcaagatctgcgccacctccatgtccagatccgtgatgccattcaatacatcgacgacgaacaagatcacgtccgcctcctcgatagccacttttacctgcttgttgatctcctcctcgaaaacatcctccgagttaaccacccatccgcctgtgtcaatcagcgaaaactccttgccggtccactccaccttgccgtactgacggtcgcgggtagtaccagcctcctcgttcacgatcgcctgacgggtacccgtcaaccggttgaaaagggtggacttacctacattgggtctccccactatcgctactatatttcccataaattctcctttcgtatgctattattagtccagctgataaccgaagttcttcaatatgttgtcacggttacgccagtctttttccactttgacaaacatttccaaaaacaccttctttccgaagaaacgttcgatatccttccgggccatagcacctactttcttcaatgcttgcccttgatgcccgatgataatccccttctgggtatcacgctccacgatgatcagcgccttgatatggatcagctcatcatcctccttgaacaactcaacgaccacttctaccgcataaggtatttccttctgataatataacaagattttctcacgaatgatctcggttacgaagaaacgggccggtttatcggtcaaggcgtctttctcgaaataaggcggggaatcaggcatcaactcctccacccggcgcttcacgtaatctatattgaaattcgaaagcgcagagatcgggatgatctcggccttcggaagcaattccttccactgggccacgagcttctccagctccggctgattggtctggtcgatcttattgatcaacaagagaaccggacactctatgctctgtacccgtgctaggaactcattatttttatcaatcgtctcgacaacatccgtcacgtacaacagcacgtcggcgtcgcctaaagcggattgagagaaattaagcatggattcctgcaacttataattcggccgcaagactcccggcgtgtcagaatacacgatttgcatatcgtcggtattcacgatacccataatacgatgccttgtcgtttgcgccttcgaggtgataatagagatccgctccccgaccaaacgattcatcaacgtagacttacctacgtttgggtttccaacgatattgacaaaacccgatttatgctttttttccatcatacccccatttcagataaaccgctccccacgtaaagcccgctccaaaagcggcaaggatcaggttatctccttttttcaattgattctcccattcccatagacaaataggaatcgtaccggcgcttgtgttgccatatttctggatattgatcatcaccttatccatatctacgcccaagcgtttcgccgtagcgtcgataatccgcaggttcgcttgatgaggaacgatccacgcgatatcatcatgcgtcaagccattcttctccgcgatctcagcggccacgtccgccatataagaaaccgcgtacttgaacaccacacgtccatcttgataaacgaaatgctcacggttgtccaccgtctcgtgagaaggaggataagccgagccgcccgatttcatgatcagatgcggatagcctacgccgtctgtccgtaaaatagtatccaagacaccgaactcctcggtagttggctccaacaagaccgctccgcaagcatccccgaacaaaggacaagtagaacgatcttgataatctgtaatagatgtcatcttatcacccgatacgacaaccaccttcttataacgccccgagcgaatataattagcgcccgtctccaaagcatacaagaagcctgcgcacgcaccttgcatatcaaaagtcatcgcattcttacaacctgtatgataagcgatgatagaagaagttgtcgggaaatgatgatccggggtagtcgtagcggtcaagacaacctctacttcttccggattcaggttcgttttctcgagcaattgcttcacggcccgtatacccatgtaagagagtcctacgccctcccctttcaatatcctgcgctccttaatacccacacgagtcatgatccactcatccgtcgtatcgaccatcttggaaatatcctcattcgtcaatacatcttcaggaacgtatccacccactcctgtgataaccgcatttatcttatccataactttaaaaataaaaggactacttatcccaattaaaaaaaagccctaaaaaaacttttagggctatttcttttgttcatcaaaccatataagttgacaaacttacacggcagcttctttttcaatcgctaatttacctctgtaataaccgcactcaccacatacagtgtgatagatgtgccatgcgccacagttcgggcaaattgccattgttggagctacagccttgtcatgagttcttctcttggctgttcttgtcttaccttgtcttcttttaggatgtgccattgttttatttatttaattgttatcattctctagcaaacctttcagagcatcccaacgaggatcggcaggactagcgtttccgtcatcttccaacgccaaatcatcacctcccctgtcatcctcaaaatcgtcttcggtctcatccgaacttctggcggtatgtttcttcaatttagacgacattgccttattacatttacccggcgcatgtacatgcttcatgggaaccgccaaagcgataaactcatacaggaaccacgccaaattaatagcgccctcctcttccggtatcacgacaacctcatcactctcctcggcatattccttgccgaattttaccaccagacgattgtgggtatcaataggaatttccatatcgtccaagcatctatcgcatggaacaacaacaaccccttctatctgaaagttcatctcaaacatcattgacgaccgttttacggtaagatgaaccttcactttgcccttctggacctcggttccgtcaatgtccacaaaaaacttgttctccaaaagatactcgaattcgtgtactcccggagagagatttttcaaatctacattatataatttaaatttccccaaagccttttagtgtaaaaaccttgcaaaggtacgaaaaaactaaatacaaaaacaatacctttatgcttattttttcctataatacgatttaacccttatatttcttcaattttatacgaaaagtcgtccctttccccaactccgaactcttcacgaaaatctttcctccttggaaggactcgataatacgctttaccaaggacaagcctagtccccagccacgtttcttggtcgtataccccggattgaaaaccgtcttgaattttgattttgggataccttttccggtatcagacaaatcgatcagcacgaacttctctctttcctctacttttagcgaaatctcaccctgcccctccatggcgtccaccgcatttttcgtcaggttctcgattacccaagcgaacagggaatcattcattaagaccaatatcggtcgctccggcaaatacgtattaattttcaccttcgaggaaatacgggtctccatatatcccaaagccgcacggatggattccacgatatttgtcggaaccggatctggatctgaaccgattttagagaaacgctccgctatcgtttgtaagcgtttcacatccttatccatctctgtcaatagagaaggatctatatctttcgttcgcaaatattcaacccaagcgattagcgaggatataggcgttcctaattggtgagccgtctctttcgataaccccacccacactttattctgttctgccttctttgtactagccaaggctaaaaaagcgattaatataaaaacaaatacaactgataattgcgcatagggataaacaagcagtcgctttaagataatcgaatcatcgtaatataaatattggtaagtaccatcctccatgtcaattacgatcggaggatttttggttctcagttccttaaccttattcgtcatgaactgcgctacattcttttccggaatctctatattattgtaagaaaccacgctatccgtctcgctgcataatataacaggaatagaagtattcccttggatgatttttaggataagattcatattaaggcttggattctcactggtcatgacccgggttgcctcactccaaacctcgatcttctgacgctcttctcgggccagatctttaatcaagagatccgagactaccacagaagccatagcgatcaatacagcggcaaaaataaagcctaatttccatctttgacgagaatcatatatgctgctcataaatcagaatcattcggtgaattcttaatataacggcaagatacgaactttattgttcccgattcagcaaacaatgaaatctcacccaattgtagagacgtagcgcacagcgtctcatcccttcaaatggtaacttagaataccgtcagacgatacgagatgcggcacgctaggtctctacaacggctggtgtatataacagaaaaaggagtcaccccttacggactgactcctctccatcggctatcgcctgaaccgctctttaagtcgctcacggtgatagaggcatcctcgagtcccaccttggtccataacacggcttgtgcgtttacccgttcccctttccatgctttcgtctgccagcgattgcttttcttgacatcgggaatactgagtttcggatatcgtatatcggtcgtgccccagcttaattgggttggggccgataacttgtcccagatctcgtcgctgtcatgcggtttcgtgtcggtcaattccgtatagtcgcctagcgggtatttctcggattgctgggctacggtaaaagaacttagtgccagaaaggcacaaaggatgaaagtgtttttcatacgattgcttattttagaatattaactagggcaaagataggaattagttgacagttgtcaactgtcaactagccttttatagtggcatacgagcagattcccctcatcatcgtataagtgcatcccgttgccttcgcaataacggaacatcttacaatccgcgcattccccttttttagcccactggcggttgcgatacggtttaaactcattattccatatatctatgaacttatccttgtagatattcccttggtggaagttggcccggatactgggacagcccgagatcgctccgtccgccaagaccgaggccgtattgatgccggcgttgcattggaagatcgaatcgcgtacctccgcctcataattcccgaggaagccctcgcagccgtagctaacgtgtatcttaccctctttccggcagaagcggatgaagttcatgacccatgtgaactgttcgtttgtcagttgcaaatccgtctcggttgtggcacgtccgacagggaagatcgtaaagatacgccaccgttttacgcccatctcgatcaagaaatccttgaagagtatcaaatccttgaagttgcgttggtttacgcaagtcaccacatcccagatgatctccttttcctcggccaacatacagatggcattcagtgccttctcgaaacttttaggattacggcgaagccagttatgcgcttcctcgaaaccatctaggctgatagtcgccgagtgcaatccggaagccaagagcgagtcgagccgttcccgggtcatcagataaccattggagacgatcccccaaggatatcccctgcgatacagttccaacccgcatttctcgatatccttacgaaccagcgcctcgcctccggtaaagatgacgagcactttgttcggctcgacgtaaggcgtgatatcgtctatgactttcaggaagtcttcgacaggcatatccgggacagaggccgagacatggcaatcgctcccgcaatgacggcaggatacattacaacgaagcgtacactcccaaaagagtgtacgcaattcatgtaatttagccctgttcttcttgatacttcgaaaaagctctagggcgatacgttttttgatgtttgggcgtttgtccatattttattcttttttctctttaagtttgatgtcggggatgttaacctccgctttcccatggaaccaagatttacttccctcaaatccttcgatcttgacatctatcgaatccgtctcgaatgatccgttttcaggcccgtcaatatctttagcgataatgcgtacgatacccattggggaatcctcgaattttatatcgtaacttccgtctttttgggtttggggtgatttatatatttcgcttatatatgagggagataatacgttattatatatgcccccatagttgatctctattccttggatgggatctccgttcatatctgtaacttttcctttcaactcgtattctgcgtaggggctaccatactcatctgtagcgccacaggaagtaacgctgaagcctagtagagaaagaagccccgctaaaatccagttaaaaccttttaatatggaatgatacactgtttccattttctagtttttgcgtgttagttggaagttaatttcttttgatcctttacccattaacatccctttcccttgtgataattcaatttcggcgaaatttacgataatagaatcagttttgcaagcgtttgggtcattccaatacgaagataattttgtgtagatggtatgttcgatagccgtagccttatcgtaggtgaattgatatcgtccggtctcatccgtgatagccggaaagctggaaaggtcgtcctcttgagtaggggtatatgccggtgaggttaagattgcgactccggccagcggatagccttgatcatcagttacttttccgtagatcgtgtacaatgcgtaaggttccgtatgtgtatctacatattccttaagtgtgatcttgatttccttagaggcactaccttcgtaccatccatcacctccagtaagttcctcgctgtcgaagattacttgagtcgtatcggatgcgaattgtcctccgttcatttcttcatctatgtcttccgtgatgaatcggtattttaggattggaaaatcagttttcttccaatcaaactctccgttagcgttggtccttacggtatcggtatgcagccatccgtaaggataaattcttgcgtcatttcgattgatacgtatttgggcgttaggtatcggattatcgtttgtatccacgacttttccttttatctgaaaattggcgtaaggagtgccatattcacaaattatgggaccttctccctcgtcgtcagtgcaggagaaacctaaaagcattaataaactcgccaatacgcagttggcttttttcaacaattgcaagtgcatccttttcatggtgtaaattatttttatttacgattctatttatttgatgaatggggcagcaaaatagttgcatgcgaatgcgtaagaaaatgtgatgactttttgtatctttgccacttcaatgtaacagatcaatttatgagagatttcatacgtattttaaagcgtttcgttcccccttacaaaaagtatatggttctgaacatcgtgttcaatgtactttccgctatcttgaacctgttttctttcgccttgattatcccgatccttcagatcttgtttaagatggatgaggggaattacacctttatggattggaattttaacgcgggaagctgggagtcgtggaaagccttgccggagttgatcaagaataactttttttggtacgtatccgatctgatagaggtacacggaggttcgttcgccttgattatgttgggaatcttcctgatcgtggcgactttcttgaaagtggcgaccatgtatctggccttttatacgatgatcccgatccggaccggagtcgttcgtgatatccgtaatcagattaacaagaagattacgcagttgccgttgagctttttctccgaggagcgaaaaggggatattatcgcccgtgtatccggagacgtgaacgagatcgagacatccatcatgagttcattggacatgttattcaagaacccgatcctgatcgtgatctatctggtgggtatgatcgctatcagttggcaacttaccgtgttcgtcttgatcctgctgccgttggcgggttacgtaatgggacaagtcggcaagaaattgaaacggaaatccttggaaggacagcaacaatggggattcctgatgagccagatcgaggagacattaggcggactccgtattatcaaggcctttaacgccgagaagaagatacaagaccgctttgagcgaagcaatgatactttccgccggttgacgaaccgtatctatcgccgccaacaaatggcgcatccgatgagcgagtttttgggaaccgttacgatcgctatcgtactttggtatggaggtacgctgatcttgagtgcgaatagcccgatcgacgctcctacgtttatttattatctggttattttctatagcattatcaatcccgcgaaagatctaagtaagtcggtttatgcgatccagaaaggtctggcctctatggagcgtgtcgataagatcttgaaggcggagacggatatccatgatccggaacatccgaagaagatcgccttgaaagagaaaatcagttataaagatgtttggtttaaatatcaggaagcttgggtcttgaaaggaatcaatctggatatccggaaaggaacaaccgtggctttggtcggtcaatccggttcgggcaaaagtaccttggtggatctattgcctcgcttttatgatgtgaataaagggaatatccgtattgatgatacggatatccgtgaggccacccttttcgatcttaggggattgatgggaaatgtcaatcaagaggctatcttgtttaacgataccttcttcaataatatcgcttttggagtggaaggagctacgatggaacaggtggaggaagccgcccgcatcgccaacgctcacgattttatcatagcgagtgagaaaggttacgataccaatatcggcgaccggggtggaaaactgtccggcggacaacgccagcgaatcagtatcgcccgtgcgatcttgaagaatcccccgatcttgatcttggatgaggccacatccgccttggatacggaatccgaacgtttggtacaagaagcgttggagaacttgatgaagaatcgtacgaccgtagtgatcgcccaccgtctctctacgatccgtaatgcggatgagatctgtgtgatgcatgagggtgagatcgtagaacggggcaaacacgaggagttgttggctttggatggctattataaacgactatgtgatatgcaaagcttttagggtgatactgcaacccgggttgcagtggatcgcctcttcggcttttgatggaaaaacaataacaaggaataatcgtatgaatatgaaaggactttatttgattttgttatcgttccttttcggttgtaatttgccggatatgcagactgggaaggaggtctcttattattttgaccaaccagcgcagatatgggaagaaactttgcctttgggaaacggccgtatcggtatgatgccggatggtggtattgagcgggagaatgtggtcctgaatgagatctccctgtggtccggaagtaagcaagatacggacaatccttatgcgtattactctttggcgaatattcgtcgcctcttatttgagggacggaatgacgaggcacaggatttgatgtataaaactttcgtctgcaaagggaccgggagtaatctgggggacggtgcgaacgctccgtatgggagttaccaattattcggaaatctagtgctgagatatacgtatccgaatgaatcggattctatcgctgagtatcgcaggcggttgaacctaagcgaggctatcgcttccgtctcttttaaaagggggaatgtgaattatcaacgggaaatgtttacctctttttccggggatctgggagtgattcatttggtagcggacgcagatcgggccttgaatttctcattgggtatgaatcgtccggaacatgcgacgatctctttggacggaaaggacttgctgatgcggggacaattgccggacggggtggatacgttggagatgaaagggatgcgtttcgcctctcgtgtccgtatcgtcttgccgaaggggggagatttgaccgcaacggatagtagtttatcggtgcgaagtgcctcggaagcgattatcttggtaagtttaggtacggattatttcgataaagacggcgtcggacaatccttggaaaaatacttatcgcaagcggaatctaaggatttctccaccttgcgccgggaacatacactcgcttatcgctccctgtttgatcgggtctctttggatttgggaaaaggcgaaagggatcatcttccgatccatgagcgtttggccgctttcgctcaagataagaacgatccgggattggcggctttatatttccagttcggtcgatatttattgatttcctcgacccggcagggattactgcccccgaatttgcagggcttgtggtgtaatacgattcatacgccttggaacggggattatcacctaaatattaatttacagatgaatcattggccagcggaggtcacgaacctctccgagttgcaccttccgctgatcgaatggacgaaacagcaagtccctagcggtgaacgtacggccaaagctttttataacgcacggggatgggtcacgcatattttaggtaatgtctgggagtttaccgccccgggcgaacatccgtcgtggggagccacgaatacatccgccgcatggctatgcgagcatttgtatacgcattatcagtatacattagataaggcgtatttgagggatgtttatccgacgatgaaaggggctgcccaattctttgtggatatgctggtgcaagatccccggactaaatatctggtgacggcacctactacctctccggagaacgcttataaaatgccaaacggaagtgtcgtgagtatttgtgccggatcgacgatggacaatcagatcttgcgggaattatttacgaataccattgaggctgctgggattttaggtgtggatagcgcgttcgctgctgagttggcggcgaaacgagatcgcttgatgcctacgacgatcggtaaagacggccgtattatggaatggctcgagccgtatgaggaggtagagcctacccatcgtcatgtctctcatttatatgggctttatcccgggaatgagatctcgatagagcatacgccggagttggcagaggcggctcgtaaatccttggaggtccgtggcgatcaaagcacgggctggtctatggcttggaagattaatttctgggcccgtatacaggatggcgatcatgcttataaattgctgggtgatttgttacgtccctgtgtagatgagcatacgaaggaggtgaagggaggaggttcttatcctaatttgttttgtgcccatcctcctttccagattgatggtaattttggaggaacagccggtattgcggagatgctgatacagagtcaatccggattgatcgagttcttgcccgctttgccatccgcttggaaaaacggaagctttagtggtttaaaagtccggaatggcggggaggtgtcggctaaatggacggaaggtctgttgacggaagctcgattgaaagcgatcgttcccggttctttccagatcaagcttccggcgaattctgcgaacatgagcctcaaaaagaaccaaaagccggtttccctacctgtagtcgatggaaaagtaacagtggacttgttacaaggggaagagtttgtgttgcaattctaagttaccattctgaggggatgagacgcggcatgctgcgtctctacaacaaatgagaaaaatttaatataacggtaatctataaatgaaaccgatcgaaaggcgtgcggtgtcgtccaaagaggcatcgagcgccttcgctcgttcagagaggttatattttttacctatggcggtcaagaagatatgtagattatcatcggccatcggatagaactctagtcctccttgatacccccatgccgtacggtattttcctttctcgtaagcatcgtaggctttatagatcgatgcgctttcatacattcctttcgcgaatagttgccatttgggatgaaaacgatattgtatttctcccaccagcgaaagataatcgatgttttgcatacgaaccggtggttccggttcctcttctccggcgacttcgggctgagtcaattcggtcaataatcctaacggatctaatttcccccgtgaatacatgacatcgaaataagcatagaccggtccggcctctatactttgaccggtaaagacgctatacatatattttccttgggcttgctccgcggcggatacggagtatcgtaaatgaatcaactcatccagaaagttaccgttccagttcaatgtgtaaaacaagggaactctcggtttcttaaatccttccggcagacgtccatactcatcttccatcgatcccatacgactgttcgtcacctgtaagcggatctcttgtgactcattcggctgataccccagcccgattcccgtaaggtagcaaagggagtattcattcatatcgctatactcataaataagcaaaggattctcgtcgtactcaaaaccaccgtagaacacatcttgttttccggcggttaaggtaaaacgctcattcagtttatagccaatatacgcatattcgatcgactcattcaaattctccaaggcttgtccctcataaccgccattcagcgtttggcgataccaatagaataaccgatcgttcacttctccggtaacatcaattttgacatccctgaaacgaaaggcggcttcatccagcttccccgagaaaaagtccgcgttgaatcctgcgtgcatctccaagtccagattgaaaaccttgttgcgtttcggaatcttagtcgcgtattcaaaaagagataccgaagaagaatcccgctctgggatcggagaatttgtctgagcgtaagacgttaacgcggaaccgataaataagaaggccgacagccaagccactgtgagtcgtttcatttactgatgttaattattaaagtggccgcgaagatacgaattattgctcggttttgcccatatgcttcatgactttagcgtccagatagaaaatgagctcttccgctatattcgtacaatgatctccgaaacgttccattttccggataacaccggccatatataaccctgccaatgcactacctttatgctcctctatatatttggcgataatagcagtagaattatgattgatctcatcgatcaaattatccttcaagaagatacgggaagcgatctctgagctttctttctcaaaagcctctttggtgagtgagatcatgcttaataactccgacagcatttcttctacccgggtttccttgaccagttgcgggtcaatcggttccccctcgggaaggtttccggcgaaacgggcgatgctttcggcgaaatctcccagacgctctaggtttgtattaatcttatacatcgccaatacgaaacgtaggtcgatcgctaccggcgcatataaagcgatgatatcctcgcaatcactatcgatctttagctcgaaagcgtttacccggcgttcccggctgattaccttataagcgagttccttatctccggtaagcatagcctcccctgcgttgtataattgctggtgaaccaatgcccacatctcgctgatactattttttaaagaatgaatctcctgctctataaccttcatactcttctaattttcaatttttaattttcaattacccaaaccgtccggtaatgtaattctgtgtagactctttctccggattggtgaaaatcttccgggtattatcatattcaatcaattcccctaaatagaaatatccggtcttgtcgctaacacgagccgcttgttgcatattatgggtaacgattacgatcgtataatcatttttcagctcatgtatcaaatcctcgatcttgctggttgaaatcgggtccaatgcggaagtcggctcatccattaataggatggagggcgagatcgccaaggcacgggcgatacataaacgttgttgctgtccgccggaaagagcgaatgccgattctttcagtttatcctttacctcgtcccaaaggacgacctgctttaaagtcttgaccaccgtctcctcaatataattctcatcgttgacaccgtttacccgcaggccataagcgacattctcataaatcgtcttaggaaaaggattcggtttctggaaaaccatccccacgtttttacgtaagcgatccactttctcgcttttcgtataaatatcccttccatcaatcaggatctgaccttccatgcgagtgcctggaatcaaatcattcatgcggttgaacaggcggaggaaagtagactttccgcaaccggacggtccgatgaaagcggtggacgtattcggctctatctccatggaaatgttcttcaacgcatggaaatccccataataaaagtctacgtttttagcatcaatctttatcataattgtcttatttttttaattcatttttaccttcttggcgaaataactacgcaaggcattcgccaaaaggtttactaataatacgatgacaatcagtacgagtgccgtgccataagccatcccccgggaagcctcgatatccgtaccgcttgtagagataacatataagtggtaaggtaatgccatacattggtcgaaaatacttttcggtaattgtggcaagaaataagcggccaccgtaaaaaggataggagcggtctctccggacacacgcccgatcgaaagaatcaatcccgtaataatattggggaacgccatcggtagcacgaccctgcggatggtctgcaatttcgtagcccctaacgctaggctaccgtgacggaaagaatcatcgatacttttcaaagcctcttccgtcgtgcggatgataagtggcaaggacatcagcgccaaggtaaacgaacccgctataatagagtctccccatcccaaggtacttacgaatagagacataccaaataacccgaaaacaacggaaggaacaccacttagattattcgtcatgatacggatgaagcggatgagtttcccgttcgtggcgtactcgttcatataaataccactcatgatgccgataggaaaactaatcaagctacttccgatcactaaatagagtgtacctacgatagccggaaaaatccccccggaggtcatgccctcttggggtgcttgtgtcaggaaatcccaactgatcacgctcgctccctttaagataatgaatcccagtattacgaataagatcactacgaccaaataactcaggaaagaaaagaaaccgaaagcaacctgttgagaggcccgttttctcttgtctatattccctaaatgttgaataggtgccatatctttaattaaattttacgtttggatgaaatatattctacggcgatgctcaaccccaaggtgatgaggaacaacacgactcccagcataaacaaggcttggtaatgtgctccacctgcgggggcctcacccaattccgccgctatcgtggcaggaattgtccgtaccggttcgaagaacgaggtagggataacggcggcgtttccggttaccatcaatacggccatcgtctcaccgatcgcacgtcctatacctaatacgacagcggacgtgataccggatatggagtaggggattattactttatagatggtttgccattgcgtggctcccaatgccaagctggcctctttcatggctcgtggtgtagttcgcatggcatcttccgctaccgtgatgatggtcggcaacgccatgatcgctaaaaccacgcttccggcgaaagcggtctcgcctaccggaaggtctaaggtcttttggataaggggaacgatcaccaccaatccgaagaaaccataaacgactgagggaatacctgccagcaactcgataagcggttttaataaattgcgtgtttttgtattggcgatctctgccatatagatcgctaccgctactccgaaggggagggataaggcgatcgcacctatacttaccaacagcgttcctagtaatagagggatcagcccaaagatcggagcgggagttgaggtcggataccatttcgtccctccaaagaattccgaaggcttgatcgtggctccagatatgatttttcccgtaaagttttccgacttgtattgttccggaaagaatgcgataatcccgggctctttatggataagttcattgattttctcgggaacatattgaaattcttcacctagctcttcttccgtataatagttggttagatccgagaaccggaagactagtatatcttgattttctccgtttaaatcttcccaattggtgatattggcatcgaagacatccatgatttgctcgggcgacaaatgttcgaccggattttcctgattcacggccaatatatatccttcctctacctccgggctgttaaaaagacctgcggcctctttaaataagaagacaatgatcaacaagatcgtaaagctactgacgcttccactgatcaaaaatcctccttccactaatttttcaataaactttctcacaatctttgcctatttattctgatgcaaagaaaggatatccatattaagaagctgttaagcctgtttgaaagaattattacaaacatattacgagtttgtaatatatacaattgaaataaaaaaggctccgttatgcggagcctcaaaatatattggagattatagattttctagccattttttaccaggcttggtatatagccatacgaggaatccacctccaacaatagcactgatcgtgaaaactaaacttagcatatccataataaaccttatttaaaaattttatttccaatccaggcgaatatcactgttgctattccaccaacgatagctctatatataaatattgactcttttagctctgtatcaaaagtagcaatacctccaataaccagacccgcaaaagttaatttagccaaatcatagaagaactttcccaggttttctctacgggattgatctctttccctgctttcttttttttcatcctgttgtttctcccagtttcccatataacaaagatatgaatagtttttagataaacaaaaggccatcccgaaattattcggaatggccttgagataagtatgtaatatgtttgtattacttattatacttgctccaatccacattgtgcatatctccgctggccgctagttcctcatggaaagcgaaacagcatttcaggttttgaggcgtatgtcccttgatacccatagcgaggtactcttccaataacggtttgtaatccgggtgaacacaattgtcgatgatacaacgagcgcgttggatcggagatttaccgcgtaagtccgctacaccatattccgtgatgatgatcttcacggagtgctcgctatgatccaagtgagataccatcggtacgaacgcactgatctttccatccttcgccgtagacggagtcgtgaagatcgacaacatagccgaacgggtaaagtcgccggaaccaccgataccattcatcatacgagtaccggatacgtgtgtagagttgatattaccgaagatatcagcctccaaagccgtattgatcgcaaccaaacctaaacggcgggcaacctccggattgtttgagatctcttgcggacgaagcaagatcttatccttgaagaaatcaagattagcgtagatctcacggatcacctcgttacttacggacaaagagcaaccgctggcgaatttaacgcgaccttgtttcatcaattcgataaccgcatcttgaataacctcagtatatacattgaatgcggggatagactcattagctcccatgcagcccaagactgcgttagccacgttacctacgccactctgcaatggaacgaattctttcggaagacggccggccttgatctcgctaaccaagaagtccgcaacgtttttaccgatcgccatcgtaacatcatccagcggagagaattttccaccttcattcggctcatcggtccttaccacaccaacgatcttagccgggtctacttttacacaatcgttaccgatcctgtcagaaggagtgtagatagggatctcacggcgtaaaggaggatcagccggctcgtaaatatcatgcataccgcggatttctttcgggtgacggcagttcaactcaacgatgatacggtctgccatacgacagatagtaggtaagataccaacacctgaagtcggaacgatctcaccatcctcagtaacatcggcagcctctacgatcgctacatcgatcttacccaagaatccgtaacgcaagctttgtgccaattcagacaagtgcaaatcgaaatattgtgcctgatgagcgtttaatgcggcacgtaagtctttgttcgattggtacggtgtacggaatttgatggcgttagcgcgagccaattctccgtctagcttatcaccggtagaagcaccggtaaacataccgatttggaaagggttacctttagcgtgttcttccgctgccttccgggcgatagctccgggaacgactttcgggcatcctgcgggtgtaaaaccactgaaaccaacattgtcattatgatgcacataagatgcggcttcttcagctgtaatgaattttaatgccatgataattagtttttatgtttttaggtaaatacttactgttcaatatttcgggcgcaaacttacataaaattacgctgaatcgaatataagtgtggcgtaaattaatacttccggtttagaatctccgcacaaatgatcgctttcttcaattcctcgatgtctctgaaggtatcttccggcataagccccggttcttcctcgatagcactcatccttacggatggccgggtcgcgatatgattcgggatattcttctcggcggaaaggaatggagatgaggcaggcgatgaggttacgacttgcggtttctcaacctttggcgttacctgcttttgtcggggagcgggcttaggtttttgcgtttccttttgcatatcctccagtatctcccagaagccttttccttctgtaggctggtcattaggcacgatttccctgtcgggttgccccaatatatcggggcgactcttcttctttttgtctttcgaactgaataagccactgacggcggcgataatcaggaaaacaatatataaccaatctcctacgttatccataaactttgattatttttgcacctccaaatgtaagaagaataattgagaagtgaaaagatgggagtatataaaacatcagataggtataaaagtaaataagggtaacttcacagccacccttattcgatttaaccaaaaccttaactatgaaaaaatttacgtttttcgaatgcaaatataacggtgggattcgaactatgcaagcgtttgcgtaattatttttaagaatcttgcttatttaaattctattaacatatagtatggtaaatcaagaaaacggtgtggacttaaaatccgctacccaaagcgatgaacgaaagttgtttatcgagacctacggctgtcagatgaatgtggcggacagcgaagttgtagcttctatcatgaagatggatggctatagtatgacggagaatatcgaggaggcggatgccatcttcgtgaatacttgctccgtacgcgacaacgccgaacagaaaatctatgggcggctacagtatttccagtctttaaaacggaaaaagaagtcattaattgtcggtgtattgggatgtatggccgaacgagtgaaggaagacctgatccatgtgcatcatgccgacttggtggtaggaccggattcttatctggacttgccgaacttggtgggagcggtagagcacggagagaaagcgatcaacgtggagctttctacccaagagacctataaggatgttattcctttgaagttaccgggcgtacatatctccggtttcgtgtctattatgcgcggttgtaataatttttgtacgtattgcatcgtaccttatacaagaggacgcgagcgtagccgggatatcgagagtatcttgaatgagatacgggatatgcacgagaaaggctttaaggaagttacgttgttgggacaaaatgtaaactcctattctttcgagaaagaaggtgagaccataaccttcccgatcttgttggatcgtgtggcgaaagaggttcccgatatgcgaattcgttttacgacctcccatccgaaggacatgagcgatgataccttacgtgtgattgccgcgaacgacaatatctgtaagtttatccatctgcctgcccaatccggcagcagtcgcatcttgaaggtcatgaatcgtaaatatactcgtgaatggtatctggaccgtatagcggcgatccgtcgtatcgtaccggattgcgctatctcgactgatttattctgcggtttccattccgagaccgaggaggattatcaagagactttatccttgatgcgtgaagtgggatatgatagtgctttcttatttaaatattctgagcgtccgggtacatatgccgctagccatttggaggataatgtaccggaagaagagaaggtacgccgtttgcaaggtatgatcgatttgcaaaataagttgtccgaggaaagtaacttgcgggatataggcaagactttcgaggttctgatagaaggattctcgaaacgttcccgtgagcaattgttcggacgaaccagccaaaacaaggtggttatctttgacaagaagaactatcatgtaggtcaattcataaaagtcaagatccataaggcttcctcggctaccctgttcggggaacctgtggaggaataagaaaaagaaaacgccaatacgttccatttcgagcgatattggcgtttctcttatttaaaaatcttattcacaatgtaacattctctattgtgatttgcttctgacaagaataatcactaaatttgtgttattctaaaacaggaagttatgtcaagagatgtggtaaaacaagaactattggcgaaactgaagcaagaacactgcttctggtcgtacaacgaaaactctatcaaggatattccagatgatatgctgatagagaaaactttgttgcatcttgacttggaagaaataaaccaactgtttctaatttatcctttcaagaaaatcaagcaggtgtggctggattatcttgttccccaagcggaatatctctacacgttgaatcgtttcttcgcatggtattatttcaaggcaaagaagccagatgcttatataaagtctatggctactcgccaccttaataaaatgtttgcatgaaaggtttagctccacacacgctgcaagtttttgaagctgtctctaagctggactgcatcaaaccctatctcttggtaggtggcactgctttgtcattgcaaatgggaactcggcaaagtgaggacttggactttatgaaatggcgtacttctaaaacagagaaaatggaagtggcatggtatcagatagagaaagagctcgctgcaataggtgacactcagcataagaacattttagatatagaccatgtggaatatttagtgtctggagtaaagttctcgttttatgcctgccccaaatattctcctgtcagtatgcctgtggaatatctgaataatctcagattggcagatgtaaagtctattggagctatgaagatggaggtgctgctgcgcaggagtaattttcgcgattattatgatatttattccatcttaaagtctggtgtacctatcaatgatttggtatctttagccctcacttactctggacataaattgaaatccaaaaacctgttggctatgctcaccaacggctctcgttttacaagagactcccattttgaacaacttgcaccgacttatgctgtaactgctcaagaaatagaagattatataaagtcttgtttattataaactgctgcaacattcttgcgaatggggttatatatagaaatgaaaaaaactaaatcatctaccatatctgccattatctatataagtatctaattataagaaatttgttgaatggtggtagataataaacatctaccactatcagcttgtatctaccactatttactgcttttcaaccactaaatgcagccgttcactattcgctaaccacattactcgttctgtgacggtatgccaacaggctgtctgcttggttatttgtatactttgtgtattgatttaaaatattgaataataggtatttatagttttttaggcataaaacaaaagttatcatagcggaaaacttttgttttgtgcttacgaaacttttgttttccctagaagaaactatttgttcccctaagggaaactcttattaaccctatcgctttgctcatgtctttcaaaaataacacgtattctcatccaatgcaaagaaaaagtatcaatgttaagtataagtggtagatgttgaatgataattgtagatgtcaggctatctacaacctataggtaatgctttgatttataaagcatacatggcgtagtggtagatattgcagatgttttcataaaatcaatattgtagaattccttttatctccattatgtatagttgcagtctgatatttggttagtcatgctattccacatgctttaagaagagaatcttatggcttatgatgatatgaagtttttagagtagaaaaaatttttacgtaaaaatctttgatctataagtattctgtaatagataaaaacgcctagtctaaacgatcgtttattctaggcgttaaagataggctatatttttgaataaaacaaaatccagagaaacttttaaaaattgattatcaacgcataaatgtaaatatggacgcttatgcgttgaattcaataaaacgccagaataaaatgatcgtttagactagtcgttttataaccgatgattttgcataactgcttgtaaatgatgattatgagaagactgatatgcagaaaactacagagtttatgaatatagggtgaatgttttaaataattgaatattactaacttataaaaattaatcgtatgaaaagaagactacttttcttgttcgccgtgtttatggtggcaacgagtgtggggtggggacagacggatttgtatgtcagcacttcgggttctgatgataacggaggtggtgtggaagctcctttggctacaattgcgagagcgattgaaaaagccgcagatggggctaccattcgtgtagcagagggaacttttcctgtttcatctacaatctctaaagcgttaactattgttggagaaggaaatgataaatcagttctcaaagggtatctcattatttcagcgggtacgcaaaagaacgtttctttccaaaatgttcagttgacgaatgaggcaaaagtttatagtagccccacgaaacctgtacctctgattttaatgaaggatcaaagtgcggttttatcgttaagaggatgtgctttgattaataacgcaaaaggatggtacgttggttatggtgaaggtgtatataaaaagatgggtatctctatccaatctgattccacggctctgggtggagagattcatttgattaattcttcgattatgatggcagcggataatcaaagtggtatttcctgcaatggtgcggtaagccaattgacgattgatcattccttgattacagttaatgaatatccacgatcaggcatatttggtattgatgtgcattgtgacggtatgaacgtagatataagtaaatcgacgatagaattaggtaaattttattatccaatatatatcttaggcccgaatcagactataaatataaaagatgaatcacttattaaaggttggtgtgctatttatgctaatgcggtatgtgataactctgtggttaatgtctcttcttcgaagttagtaggttatagtgagatgacaggcgctagtaatggtttctctacattgcctatacaagcgacgatgaatgtgcgatatgtgattacggattcggaaatacagacttccgttaaagatcaaactatatctccgatgactcccataagttttgcggagaatacatatattgaagattctcatgcaaataattgctatgtagaattgagaggtaatactatagttagcttgatgcgccaagataataatccggctttcatttctgatgattctaattacttaaatagagtattggctgatcaatcagtaaattttaggacggtagatgcatcgggtaatgaaatctgtgaagccattgtaattcgttcggcgcaaggtgatacggttcgtatggcattggatacgacggcatttaagagttgcttgacctcggcttttgagaatgataatattattctaccaataggtacttatactttacctcagacattgacattggatagatctcaaggacttataggtgcgggtaaagataaaacaattgtaaatggacatattttcgttaattcaccatccgccggttcagttacattgaccgcaagcgacatgaccttaaaaggaactgataattcctctgcgcatgggcttattggtatgattggaacgggcaaggatatcgtgaagttaaccaattgtaagttagatggtggttcggttaccgctcaaaccgccgccgtaggtgtccgtatggaatctgtgggagcggatttaagcttgacgaatacggatatcgatgtcaattattatggaataggcttacggaataaagagcaagtcttagatattacgggagggacctttaccgcatggggcgcgatcatgacatcagccggaggcctgaatccaagtgatggcacattagctaatacgaatacccggataacggcgaaagacgcgacattcatcagtaggactcttctgaatgggataagcaatagttatggagctgttatttttcaagaaaagtacaatggagttacagctgatttcacgaattgcgagttgcgagcggtagatggattagatcctttgataaatgctacccaagctacggctacggatatacgttcgtatggaaatacgatcacatttacaggttgtacgttgtcttctttggaaggaacgaataatctcccggatggaagtaacggatatttacatgccggagttattcggctaggttggagtggaacggatgataagtcagaatttgcggataatacgataacgatcaacaattctacattgaatggcaaggagggagagaactgggtctattcacatcgcaaaaaggaggcgaaaaaatacgacaagctgacgatcaatggaactgtttatgatccggcctcgggtcttatttgttatggagagccagatattcagaataagattgataatgcggtagcgggagagacgatttctgttccggcgggagaacatgcgggtttcaatgtcactaccgctgatgtccggataaagggagtttatggaaaaacgattattaaagggccggagaagtatacgggtcattccatcgcttgtatctctgcggataaggtgactttgatgaatctttctttcaagagttcaacgccaagatcgaatcttctaacagctttgtttgtcggtggtggtacggttgaggttgatagttgtatctttgaggataaacagtttgagcgggggttatattcagaaccgggtagtactcttaaagatgcgaccttgttggttcataacagtacttttaatgtatatgataagaatttgttgatctcagcgggacgacttaacgctacggtcaagaataatgtttttacggatagtgatatttcggtagcgaagaatgacggctcgaatgtcgttgaatcaaatgagttccataattgtgtcgtgaaagttgaggatggtgtaacattccaatataataagatgtacccgggcgaccagacatatgtatattccattcgtcccaataatttagagggaacggttgttgccccgaataattattggggaagtgataatccggatttttctgccttgattgataaaagcagggcaccgaacggatctgtagattatttcccatattattcggatgtcgctttgggtaccttaatctataagatggtaacgatttcggaagatacggtctgggccactccgcatccaaatcaaaaggtcaccgtcttggatggcgcgactttgacgttgtctgttccaatgtctttagataccgttaccatgagagaaggtgcgcaaataaagtcaaatcttgcggatcaaacaggaagcgtgaccactaagtctcttcgtttctctccggatctctccggtactgagtggaaggcgttaggagtgccatttacctctgccgtgatcaagaactctacggaggaggagatctcggctccaagtgttcaaaatgttgataatggtatctggttcgctaggctgaaggataacaagactccggagttcgtggtggatgagagtgcttttggcatggctggtctttgggcggctaatggcgatacctatacgatctcttccgaaggagcttttgaattcaagaccttggaagaacctgccgctccaactgaaacaggtactttcttgatgtgctcgaatccgaatacatttacgattaccttgaaacaatccgcttatatattgacagcggatggaacctctttcgagcaagaggcaaacccggagatcaagcctttccaaagctttgtcttgacagacgccaagacattgagtacgcttcgctctttacgtatcggcgatggcgtggttacgggtaaccagacgatcgagccggtagatggttattacgtgactaccgatcgtggtgctatcgtgatccacacgccggagcctatggacgtggtgatcatcggaatgaatggcaaggtcgcttatcgtggcgaggttacggacggacagcggatcatggtttcttcgggcatctatgccgtgaacggtcaattagtaagggttaaataacgattaaaacaaagataaacatgaaaaagagtatattagcgatattccttgctgtcatcgcgatggcacaggtacatgcgcaagattcagatttacgttccgccccggatcttccgacgttcaaggtgacgttgaattatagctcggcgaatacggatcaaggaaccataaccagtacggtagccacaggttccaaggtggcatataatagtaaacccgttttcacgatcatggcgaagcccggatatgtcctgtcggatataacgatgaatacggctactattggcacgttgccgagcggtacttttcaaaatgataatacgaccacttattcctatacttccaccgctttaaccggtagtacggaaatcaaggcggtgttcaaggcaaaagagcaggtgacggtcacgatctctcctgagtatgccaccttggatgagataagggcgaaggtgaatttgcccaaggttacttttgacccggttattacggggtataaagtacaatacagggaggatggctctgctgctttgacggatgagctacccgaaaaggctggactttattatgttgtcgtaaccaagtcggagactgatacgcaagtcgccataaacaaggagattctattcaaggtacaacctccccatacgctttcctactcgtttgaggaggcgcaaggatctgtaaccgcttctatggatggctccactatcgctagtgatggtgagatcgtttataataagccagccgtattgaatattacctccaagcccggttatgtgttgagcagacttaccgtagataataatgaggtgactttgccgaaaggaacttttaattcttctacgaatgagacttcctatgcggattatacgacatcggcattgaccgcttctacggttattgacgtgcgatttgccgcgaagaaaaccgtatctgtaacagccaatccattatctgccacgaaggatgaggttttggctggtaagaatcttccggttatcacatttacccccaatacgatagcggggcagaaggttcaatataagaacgcttccggagctttatccgataaacttcctgcggcggatggtgtttacacgatcgtcgcgaccagtcccgagactgcggaatatgccgccttgaaggatgagaacatgaagtttacggtatctaaagcgaatgtattaaattataacgtggaaacggccggacaaggtacggttaccgccaagatgggctctacggacatggcaagcggtagcgagatcattaacgggcaacctgccgtatttacaattatcgctaaccccggatttctattgaataagattgttgtgaatggaaccgcggtatcagccttgccaaaaggtgcgcttaacaaggataacaccatctcttatacctatacgaccgcctcgttaaccgcctctacgaccttgtcggtaggtttcgccgcgaagaaaacgatttccgtgagtgtaacaggttcttcggcgacaaaagacgagatcgtggccgggaagaatttgccggttattaagtttacgccggaaatagcgggacaagtggttcgatatcgtgcggccgatggttcggagacttccacgttaccgcagatagtcggagcttataagatcgtcttatttagtccggagaccatggagtatgccgcattagaagattcctctaaaacgtttacgatccgtaatgccaataccttggcttacgctgtcgatggtggacagggtacggttaccgccaagatggacaacaaggacatcatgagcggtggtgagatcgcttacggtaagcccgtcattttctcgatcgtatcgaatgccaactataggctaggggctattaagcaaggctcttcggacgtggatatctcgaagatcaagggaacgtatgccaatggaaatacctcttacacgtacacgactcctagtctgacgagtggcgatagctatacctttgcgttcgtctccaaggatacggtgaggttcgtggctaacaaccttgtccagacggtcggctccatcaagccggtcacggtaacaagcgctgtagaggatatcaagatcgaatatcaattgagcggtacggcttgggttacgacattgccttccacgctggccgtgggttcttataaggcccgtttgagccgtgcggaggacttgacataccgtagcctctctgatacggttacgttagtggtggagagtaagaaagaggtggaaaatctggtattgcccactatctcgggtcgtatagaggaaggacagtccttgtccgcttacgtgttgacgggaggctctacttccggtacgttctcatggaagaacccgaacgacaccatctccgcggaggagtcaacggaatatgggttgatatatgagcctagcagcccgttgtatgcggtgaaagatacgtttatcaagttgagaggcgtcgtacctgtctatacgatgttggcaacggccggcagtaacggaagtgtcaagctggaaggccgtacggccaatgaccggtacgcgggcgattcccggttgacagcgaccgccatcgcggataagaactatgtgttcgtgaagtggagcgatgggaatacctccgccaatcgtacgctggaggcgaccaagaaccgtaatataagcgccgagttcgccccgatcgagtatgaggtgacttttgataccccgtcaaatggctcgttgaatgtatatgccaatggcgagcgtgtcacgagtggagagaagtggttgcaaggaaccttattgacgatcacggtcgagccgaaggccggctataaggtccaagcggtaaaggtaaacgacgcgttggtgaataacggctcgtatacgctgatccaagacgcggatatcgctgtgactttcgagaggatcgtgagcggtcatctggtaaaggtgggctcatctctaaacggtagcgtagccttgataaacacgaagacgaaggcgcctatcactccgggtgacgcggtgaatgaggacgtgaaagtgaaagtgatcacgaaggcggattatggttatgagatgaactccgtagaggtggatggcgcgacttactcgccctccgatagcacattcacggtaggcacgggagaggtcaaggtggatgtcacgtttggacttgcgcaattcgaggtcaaaaaggcgatgaatcttgagcgtgccggaacgatcgtattaaagtctgaaggtgtggaagtcgatgagaattcaggcatggactacaaaaaaccattgaccgccacggtcacggtcaatgaggggtatcgcttcgtgagcttgatggtgaactctaccgagatcaagtccggcgagagcttcacggtgacgggcccgatgacagtcaccgccaatttcgtggagaagaaggatttgtcagacttgatagagaggacaccccagacgcttgtctataataagctatcgagaagtttcagcgtaaggctggagggatattccggcctgaatttcgatgtctcctatagcctaggcggagcgcctttggacaacccgaaatcggccggcacgtatgacgtgacgattagtcgcgccgaggatgacttatacaagaaagtagaaaatgtaacctcccaattgataatcactaaagcggacatggccttgctggaggaaccttccgtagaagggaatacggtaacagccgagcttacccaagattttgcgggagcgatctggaatccatcagaacagagatcggctctccgtgcggccacagatggcgagatttccggaaacctcaaagagaattcggttaaccgcttgcgctttatgccgcttgactcgaaaaattacaatccggttgattattcgatcgtgcggggatctgtcgaaaacagctttgcgctaaccacgaagaatacggaagtaacgaacggcggcttggtggtcgctactcgtaccttccccgaaggtacggagttaaggttgagagcggtcccgggcgcaaacgagcggttcataaaatggaaggaagataacagtacaaatgctgagcggacggtaacgatgaggaatgccattactctcacccctctatttgaaaaaaagcaggaggtgaagatgaaggataccgagcccttgtcgttcacatacgacggttggatccattgggtcggattggatgatatattggcaaaaccatatccgaaaaacgtgacggttaagtatacgaatctggacggatcagtggcaaccccgatgaatgccggcacttacttagtggtggtatcgtatgcgggtgatgatgattgggcacctttcgctaatgacatccaaggaaagagaatggttatcaataaggcgaaggtggatttgaccgctccgaccgcttcggagatcacggaaggccaagccctctcagagtccgtattgtccggtggtgtagcgaaagccaaagatggaactaccatatccggtaaatttgaatgggctgacgcgtcagctatattgaaacccggcgatagccagaaaaaggaagtgatcttcacgtcgtatgatccgaattatgaggatgcgactacgaatgcggaggttacggtgaaaagttcggatgcgttagttgtcacgttcgctcaaccggaaaatggttctttgaaagtctatatgttgaaaggtgagggcgagaagaccgagataacgagtggaaccgctgtggcgaaagcgactaagctaatcattgaggcggaagccaatccggattatgaattggccgttattcaaataggcgaagagaagtatacgacttcgcctgtagagattgaagtcgataagtccttggctattacggcagagttcaagccggtttctacacctccgggaacagatgtggctattacgggagtttctttgaatatcacgtccaaggcattggccgtaggtgaatcttttgccttgcaagcgaaagttacccctaataacgccacgatgaaaaccgtctcttggagcagcagcgacgagacggtggctactgttgacgcggatggtgtcgttaccgctctgaaaatcggtacctgcaagattaccgtggctaccgatgatggaaacaagacggcgtcttgtgtggtaactgtctccggtacggtaggtatcgagcaaatcatcaacgatcatcaaatctattgcgagcgaggtgcgataaccgttcatccggcccgtccaatctcgatccgtatcatagcggtgactggagttagcctgtatggcgactcaattatcggaactacccgcatcccggtatcgacaggaatctatctgatagagatcaacgagaatggcaagcgtataacagtgaaagtaaacgttcgctaacaaccttattttaagaaactaccccttgagtctttaatgttggggaaggccgctaggaatactcagttccggcggtcttctttttttatcctataggctttactttatctgtttttgttctgatataattaaataaaacgttatctttgtatcatagaaaattaaaacagaaagccttatggaaaaaaatgaagaaaagaaaaaggaagaaaatgccaaaacgaacacaactgtggcgaagactggaaaaagaaaggtaagtaagacatgggaagctatgcagcggttaaagggaagtctgattgtaaatgaccccaaatttttactgtaaatgcgatatctcattgacacgaatatttttgtatatatggcatctgatcccgaatatctaaatagggatatagatgctattattcaagaaccggaaacccttctttatataagtgccgagtccgtacgtgagctgattgtcgcttatcgaaataaaggactgtgttctaaacgatggaagtcggcagaagcgatgatcgtcgccatagaaaaggagttttatgtgaaaatattgccattgaaaaaagaacatatgcaaacgtatgcgcatatggagatcaatgaggcacagggacacaaagatccctcagaccacgtaattattgcgcatgccataacggaacatctaccgcttatatcaagtgatacccgtttcggattctatagaagtcaagggctggacttggtattcaatcagaaataatctatatattgtatatgtacgaatagcctttgttagagttgtagaggttaaatattctaaaaccctttcggcttacttattttattcgttcttttgcaagaaaattgggaggtgtgttctctgtacgcatctccttaatttatttaacgttaataagtgagagtctgatggctgaaaataaaaaagttagttctgtttctttctttaactcccggcttacgtctgttattagtatctccttggtactattcttgctaggactcattctattgatagggatgttgggtaataaactctccgtttatgtgaaagagaacttatctttctccatcgtgctgaaagataaccaaaaagaaactgagataaagaaaatgcagaagagcttggatgctcttccttttataaaatcaaccgagtatatatcgaaagagcaagccgcgaaagagttggaagaagaactgggtgagaatccggaaaccttcttaggctttaaccctttacaggcctcgatcgaggtgaaactgcattcggagtacgctaaccccgatagcctccaagtgatagagaggaagattagaaactatacgtcggtatcggagctgctttaccgaaaggatatgatggagatggtccataataatatgaagcggttgggcttgatcctgcttaccttggctgtggtactgatgattatttcgttcgtgttgatcagtaatacgattcgcctgttgatttattccaaacgattcttaattcatacgatgaagctagtgggggctacttccggctttatacgtaggccttttgtgaaatataacatagtaagtggcattttcgcctctatcttggcaatattgatgctaaccggagcgttatattatttgcaaaatgaattgaaaggttttatccagatattggatatgcaaacattattattggtttatgtggcagtgtttgctttaggtattgtcttgtcggtgatcgcgaccatttttgccgtgaataaatatttgcggatgggggtcgataagttgtattatatttaatgtacgaataataaagagttgagaaagatggctaaaagagattttgctttcggaaaagagaattttatactgattgcggtagcggttgcctgcatcgtgcttggtttcatattgatgagtggtggaggttccggggataatacgttcaatcccgatatattcagcgcccgccgtatcgtggtagctccggtggttacggttatcggtttcgtgatgatgatttttggaatcttgaagaatagcaaagataaagaagtaacagaatgagttggtttgaggccttgatactgggtatcgtacagggattgaccgaatatctgccggtgagcagtagcggtcatttagcgattggctcagctttgtttggtatagagggagaggagaatcttgcgtttacgatcgtcgtgcatgtggcgaccgtattcagtacgttagtggttttgtggaaggaaatcgattggatattccgtggtttgtttaaatttcagatgaatgcggagacgaagtatgtgatcaatatcttgatttccatgattccgatcgggatcgttggggtattctttaaagatacggtagaacaaatctttggatcgggtttattggtcgttggttgtatgctgctattgacggcggctttgctggcattttcgtattatgccaaaccacgccagaaagagtcgatctcgatgaaagacgcttttattatcggtctggctcaggcttgcgccgtgatgccgggtttgtcacgttccggatcaacgatcgctaccggtttgttattgggaaataataaggcgaaactagcccagttctctttcttgatggtaatacctccgatcttgggagaggctttgttggatgtaatgaagatggtgaaaggtgaagatgtggccgggagcattcccgcattatcattagcggtaggtttcgtggccgcttttgtttccggttgcgtggcctgtaaatggatgatcaacatcgtgaaaaaggggaaactgatttatttcgctatctattgcgcgatcgcgggattggtgacaattgcttgtacattactgaaataaagaatggattttatagctggagagattttatattttaataaaccgctaacgtggacttcttttgacctagttaataaatttcgctataagctaagtcggaaactgaaggtaaagaagattaaagttggacatgcggggacactggatcccttggctacaggtgtgatgatcgtttgtaccggaagggctacgaagcggatcgatgagtttcaatatcagacgaaggaatatatcgctacgttgaagttgggagagactaccccgtctttcgatttggagaaagagatagacgccgtgtatcccacggaacatataacccgtgagctcgtggaggaggttttaaagacattcgtgggtacgatccaacagattcccccggtgttctccgcttgcaaaatcgaaggtaaacgtgcttatgagctagcccggaaaggagaggaggttgaactaaaatccaagacattggttatagacgaactggagttgctggagtgcgatttgcctgttataaagatacgggtggtatgtagcaaaggtacctatattcgtgcgttggctcgtgatatcgggaaggccttggattccggcgctcatttgattggcttggaacggactcgcatcggagaggtaaccttggatatgtgtatgtctccggaggagatcgatgatttcttagagaagaatgtggtaaaaatagaagaagaaaaataaatagagtgcattatgaagctttcgaaattcaaatttaacttaccgtcggaattaatcgctttacatccggcgaagaacagagatgagtcgaggttgatggtcgttcatcgtgatacaggtgagatcgagcatcgcgaattcaaggatattctagactattatggaaaaggtgacgtgtttatctttaataacacgaaagtgttccccgctcgcttgtacggtaacaaggagaaaacaggggcgcgtatcgaggtgttcttgttgcgcgagctgaacgaggacttacgtttgtgggacgtattggtggatccggctcgtaagatccgtatcggtaataagttatactttggcgaggatgattccatggtcgcggaggtaattgataatacgacttcgcgtggtcgtacgctccgtttcttatatgacgggaaccacgacgagtttaagaaggctttgtatgccttgggcgagactccgctgcctaagtatatcgaacgtgaggtggaaccggaagacgaggaccgttatcagaatatttttgctgcggaagaaggtgcggttgtggctcctgctgcgggattgcattttagccgtgagttgatgaaacgcttggagatcaaggattgccagttcgctttcttgacattgcattcgggcttgggtaatttccgtgagatcgacgtggaagatttgacaaagcataagatggattctgagcaaatggtcgtaaatgccgatgtagtggatatcgtgaacaagggaaaggatgaggggcacaaggtttgtgcggtcggaacttccgtgatgcgtgcgatcgagacggccgtaagtacggatggtcatctgaaagagttcgagggctggacgaataagtttatcttccctccgtatgatttcagcgtggctaccagcatggtgacaaatttccacatgccgttgtctacattattgatgatgacagcttctttcggtggttatgagttgatcatggacgcttacgatatcgctttgaaagagaaatatcgtttcggtgcttacggcgacgctatgctaatcctttaatccggtttctatggcgacagcttaccttggattaggtacgaacgtaggtaataaacgaggaaatttggtgacagcggcggcgctgttggctgaaagggtgggagatgttcttgccctttctgatatgtatgagacggagccttggggatttgaatcggacaacactttcttgaacgccgtgatcgttatgacgacggaactttcccctatggaattattagacgctacccgtttgatcgagatcgagatgggacgtatcgaaaaaagtgatggtgcgtatcatgaccgtatcatcgatatcgatctgttaatggtggatgagcaaatcctgcatacggagcggctgacgctaccgcaccctctgatgcacaaacggtcgtttgtaatggaaccgttggcagaagtagctccgtcggtgaaacatcctgtgtttggcaagacgatgcgtgaacttttatccgaattataagttttaattatgaactacgagatttgagttatgaataaagaaattaataaagcgatgacgcaagggatcgtcttcaagaaagcgaaaggcgaagcggaagattcgaatggtaagaaaatcaagttctctgatttcttgaaagggacacatggctctgattcagcgaaatggaaggccggttttaaatataaaaaagccttacgtaattccaaaaagaagaaataattttcaattttcaactttcaattctcaattattgcgtatctttgcgaatgaattgacgtggatagatttgtattgcttgcaaccacgggaaaaaatgctaaaaacatatccttttcgttgccgtccggcagaaaaatccttccaagttcaattcagttgtagattagtaatcttttcaatttaaaacgatgagttatttattcacctccgaatcggtgtctgaagggcaccccgataaagtagccgatcaaatatcggatgctttgctggatgagttcttggcgtatgacaagaattcgaaagttgcttgcgaaacccttgttacaaccggacaggttgtcttggctggagaagttaaatcaagtgcgtatgtggatgtgcaggaagtggcacgtggcgtgatcgagaagattggttacacgaaaagcgagtaccagtttgaagcgaagtcatgtggtgtgttctcttctatccatgagcagagtggcgacatcaaccgtggcgtagagcgtgcggatccctatgaacagggtgccggcgaccaaggtatgatgttcggttatgctactaatgagactgagaattacatgcctttggcgttggacttatctcatagtttattatgggaattggcgaagatccgtaaggaagaaccggatttgatgccttatttacgtccggacgctaagagtcaggttacgattgaatacgatgataacggtaagccgttgcgtatcgatacgattgtggtatccacgcagcatgatgagtttatcggtccgaaaggtatttcacagaaggaagcggatgaggctatgcaaaagaggatcgccttagacgtgaagaagatattgatacctcgtgtgaaggctcaatatccggctcatgtacaggctttgtttaatgataatatcatttatcacgtgaacccgaccggtaagttcgtgatcggtggtcctcacggtgataccggtttgaccggccgtaagatcatcgtggatacatacggtggcaaaggtgctcatggcggtggtgctttctctggaaaggacccttctaaggtagaccgttcggctgcttatgccgctcgtcatatcgctaagaatatggttgccgccggtgtggcggatgagatgctggtacaggtgtcttatgcgatcggtgtggctaaaccgatgaatattttcgtgaatacttttggccgtgcgaaggtgaatatgacagacggagagatcgccgctaagatctgggatatcttcgatatgcgtccgaaagcgatcgaggagcgtttgaaattgcgtaacccgatttatttcgagaccgcttcttatggtcatatgggacgcaaaccccagacggtgacgaagacattctcttcccgttatttgcagaagccggttacttgtgatgtggagttattcacatgggagaaattggattatgcagataagatcaaggacgtgtttggtctataaaaaataagtggaaaaagtaagctggcttaaatgacgaagtatgttaagatactttgccatttaagttaagatacttagccgatgaagttaagatactttgccaagtatgttaacttacccttcctcttggagcatttctacttcttttactttcctgaacaggtcggacgcaaagatgaaatcgttcaacgcttggttattagaggtgattacctgctcttttgttccttgccattccttcacgccttccttaataaagatgatattatcaccaatattcatcacggagttcatgtcgtgggtattgataacggtcgtcatattgtactccaccgtaatgtcgtgaatcaaatcatcgatcaatagagaagtcttggggtccagtccggagttcggctcatcgcagaacaggtatttaggatttagggagatcgctcttgcgatggcggcacgtttcatcatacctccactgatctcggaaggatatagatgtccggcctcggacaggtttacacgttccaaacagaattccgcacgtttcctgcgctctttcgttgagtctttagagaacatatctaaaggaaacattacgttttccattaccgtcatgctgtcgaataaagcggaaccttggaacaacatacccatttcccgacgcagcatatttaactcatgcttgttcatcgtgatcaagtctctgccgtcgtataatatctgtccggtatcaggtttcattaacccgatgatattcttgatcattaccgttttacccgaaccgcttcgtccgatgatcagattcgtcttaccatcctcgaacgtcgtacttatatctttcaagacgacacgtccatcgaaagacttcgttatattcttaacttcgatcatttttaagtaagcattaaatgggttaatattacgtcggcaagtaaaatcatgatactgctcatgaccacggcattcgtacttgccttacctacctctagggcgcctccctttacgttatagccaaaataggcggcgatggatgagatgatgaacgcatatactacggatttgataatagaataccaaatgtaaaactcgttgaagtagaattgtaaaccgtactcgaacgaggaaggagtcattcccgtactcgttgagtaactggcgaatatgccgcccatgataccggtgaacatactgaagataaccaataccggaataaagatcatcaaaccgagcattttcggaaggatcaggaagttggcggaattaacacccatgatttccatggcgtctatctgctcggtgactcgcatggttccgatctcggaggcgatattactgcctactttacccgctaggattagtgccatgatagaggaagagaattccagcaagataatctcacgggtggtatagccgatcgtaaacttaggaatcaagggggaactgatattcaaggagatctggatggcgataaccgtaccgataaagaccgagatgattatgacaatccaaagagaatccacgcctagcttgtatatctctttgatcaattgcttaaagaacatactccaccggtctggaagtgttatactcttcatcatcagtagggtatactcacccattctgtgtaatgctttattcatttttatcttgataaatttctgatttcaatttgcaaagatagcgtaaaatccactaataaccatataacatcttagaaacaagattggttttatttgtaaatcctatggtattaaagtttgccacatccctcttttttaactatgtttgctttcttaaatactaaaaaatacttttatgaagcgaattcttttaggagtgatcggcttgctgtgtttatgtgtggcttgccagcggaaggatctttcttttaagccgggggaagtttggccggatgataaaggggtacatataaacgctcatggtggcggtattctacgggtcggggatacttattattggtttggtgagcataaaacggagggctcggctggaaatctggctcaagtaggcgttcattgctattcgtcgaaagatttatataattgggaagacgagggaatcgccttatcggtcgtgccggatgatacgacgagccatattgctaagggatgcgtgttggagcgtccgaaagtgatttataataaaaagaatgatcaatatgtaatgtggtttcatttagagccgagaggtgctggctattcgggagcattgagtggagtggctgtcagtaaaaacgtggcggggccttactcgttcgtaaacgctttccgtccgaatgccggtttttggccggttaatgtacaggaactacataagcaaccttgtacgctttccgcagatctacgttttagcggtggagagttaccagcccatccggatagcttgaatttattggggcgtgaccagatctccggacaaatggctagggatatgaaccttttcgtggatgacgatggcatcgcttatcatatttattcctcggaagagaatagtaccttgcatatatcgcagttgaccgatgattatacgagttattccggtaagtacgcccgtttcttcccggggcgtttcatggaagctccagccttgttcaaacagaaggggaaatattatttgattatgtccggctgtacgggctgggctccgaatgcgggacgatcggcggtcgcttcctcgatttggggaccttggaaggaattggaaaatccgtttaggggagagaactcggaggtgtcgttttattctcagagcacgtacgtattgcctgtacccggccatgcggatcgctttatttatatgggagatcgttggactccggagaacgctatagacggacgttatatctggcttcctatccgattcgagggggagcaacccgtgatcgagtggcaatctgagtggagttattaaattctcttatcgcttttttgcgaatgtatgtgatgtagatctgcggattatcacgtacattcgcgttaaatttttaagtagcttatgtcagacgaacaacgaatggtgctccgtacggaggacttggtaaagaaatataggactcgtacggtcgtgaatcatgtatcgattaacgtgaaacagggggagatcgtaggtttgcttggtccgaacggagcgggaaagacgaccaccttttatatgacagtaggtttggtcactcctaacgagggtaagatcttcttgaatgacatggagattacgaaattcccggtctataagcgggctcgcaacggcattggctatctggcgcaagaggcttcgattttccggaaaatgacggtggaagataatatccgctcggtcttggagatgacgggacgtagcgttgagtaccaaaaagagaaactggaaagcttgatttcagagttcggtttgaataaggttcgtaaaaacttgggagaccagctttcgggtggagagcggcgtcgtgcggagattgcccgctgtctggcgatcgatccgaagttcattatgttggatgagcctttcgctggtgtagacccgatcgccgtacaagatatccagacaatcgtggctcgcttgaaacataagaatatcggaatcttgattaccgaccacaatgtgtacgagacattgagtatttgtgaccgggcctatcttctgtttgagggaaaagtccttttccaaggaaccgccgaacaactagccgagaacgagatcgtgcgcgagaaatatttgggaaaagacttcgtgctgcgtaagaaagacttatagcagccgtttcaatcgcctgtttaccagtatgaacagcaggaaagataaggcggcgataagacaaaagtccaaaagatgctcggcgggaatatcgcctgtgataaactcgttatccttgagacgactgtccgacatccctattacggcgaaagcattattgacaaagtgggcgaacaccggtatccagatgcttttgctccaatagagtagatagccgaaataggctccgagtatcatccggggcaagaatccgtaaaattgtaaatggaaggcgctaaatagtatggcggcgacccatatgatcgtatgagggttggaggtccatttcccgatcactcgttgcaaggctcctctgaacaggaactcctcggttatcccggccgtaacggcgataacgataaggttggccaggattacccaaacgctatcgctggataacaggatcgtcgtcagttgttcggcgaaggtttcttgcgcccgcatccattcctcgataggagccataaacgcgggtaactccatctgcttgttgagcaatcctagcaaattgataaccggagaaaataagaacatgcaaactaaggtgagaatccagatcctgccgtctgtgattttcttgactgatagataatggcggggattgtcactacatatccaagccatggcgatagatggtagcaaaaaggtacagatcgccgagatgaactgaatgagcctcattaaattagcgtcttgggttatatcagcctgtaaaccgtgggtcgcgagtaataagcccgtggatataatagatgataaaacggctccagccaataagaatagcaggaggatcaaaagttggattatcgccggacgggtagcatatattccttttattctcataatgattcattcaaagggtaaataattgccgccaaatataaacaaaagaataaaaacagatcaaaatttgcacgattaaaagaataagtctaattttgcgacctaaaattcgatacgactattaattaaataaatcattcagaatgaacgtttcgcttaaaaacaatgatgccgtaagcggtatcgtgaaattagaaatagtgaaagctgactatgctgatcaggtagacaagagcctgcgtagccttcgtcagaaagccaatgtaccgggtttccgtaagggcatggttcctatgggcatggttaaaaaaatgtacggaaagcacgtgctggtagaggagataaacaaattagtttctgagaatctgttcaagtatatccgtgagaacgatttgcatatcttaggcgagccgatgcctaacgagacagagcaaaagccgttggatttcgataaggaagaggatttcgaattctgttttgacgtggctttggctccggagatcaatatcgagttgagcaagaacgataaacttccgttctatcaagtcgctatcgatgaagaaatgctaaataaccaagtaaacgcttatcgctcaaacttcggttcttacgacaaggtagacgaggttgaagaaaaagatatggtaaaaggtacggtagccgagcttgagaatggtgccccgaaagaaggtggtatcgttgtggaggacgctgtcttgatgcctatgtatatcaaggatgaggaagaaaaagctaagtttatcggtgctaaagtaaatgccgtagtggtattcaacccgaataaggcttacgagggtgctgaggcagagatcgcttctttcttgaagatcgataaggagaaagtggctgagactacaggcgacttcagctttgagatcaaggagatcacccgtcataaagacgctgagatgaaccaagagttgttcgacaaggtatttggcgagaacgtggttactagcgaggaagagttcaagaacaagatcaaggaagctttggctgagcaattcgctcctcagagtgacttcaagttcttgacagacactcgtgatatgttggttgagagagctggcgagctgaatttcgctgacgatttattgaaacgctggttgcttgccgctaacgagaagaatacgaaagagaagatcgacgaggacttccctcagatccttcaggatttgaaatatcagttgatcaaggagaacttggttaagaagaacggcttgaaggttgaggacgctgacatcgagaacttcgctaaacgtgtggctaaggctcagttcgctcaatacggcatgttgtctgtaccggaagatgtacttgacaactacgctaaagacatgttgaaaaataagcaaacacttcagaacatcatcgaccgtgcggttgaggagaaattggctgcttggttgaaagagcaagtggaacttgatgttaaggaggtaaccgctgacgagttcaacaaactttttgaataaaaagatctttactcggcctcttaggaggttgttttatatcaaaaaagggatttctctctaaaaatatcttagcggatagcgaaataaattgtttctttcagaaatttatttataactttgtttttccgttaagtcacagagggaaatccctttttacgtcttctcggtaaataaaagataggagaaaatatggaagattttagaaagtatgctacaaagcatttaggtatgagtggtacggctctggatagttatatgaacatctccagtagctatatctccccgacaattatagaggaacgacagctgaatgtcgctcaaatggatgtcttctctcggttgatgatggaccgtattattttcttgggcacgcaagtggatgattataccgctaacgtgattcaagcgcagttgttgtatctggattccagtgatcccggaaaggacatctctatttatatcaattcgccgggtggctctgtatatgcgggctacggcatttacgacacgatgcagtttatctccagcgacgtatctacgatttgtacgggtatggccgcctctatggcgtctgtcttattggtggcgggaaccaagggaaaacgtttcggcttgaagcactcccgtgtaatgatccatcaaccgcttggcggcgtacaaggacaggcttcagacatcgagattaccgctcgcgagatcttgaaggttaagaaagaactgtacaccataatctcggatcattcaggtagaccctatgaggagatcgagcgcgatggcgaccgtgatttctggatgaccgcggaggaagcgaaaaagtatggcatgatcgacgatgttttaacacgtaaataacaaaaacaacaataagaaactatggccaaaacaacaggcgatacatgtacgttttgcggcaggagtagccgtgatgttaatttgcttatcaatgggatctctggttgtatttgcgatgattgtgcccggcaggcgtatgagatcgtaaaggagcagacaggaggtaagaaaacttcttttggtttgaagcagaaagatctgcctaaaccggaagatattaagactttcttggatcagtacgtgatcgggcaggatgatgcgaagcgttatctgtcggtatcggtatacaaccattacaagcgtttacttcaaaaggttaccgccgacgatgtggagattgagaaatctaatattatcatggtgggcgctaccggtacgggcaagactttgttagcccgtacgatcgctaagttattgcatgtcccgttcgctatcgtggacgctacggtacttaccgaggcaggttacgtgggggaggatatcgagagtatcttgacccggctattgcaagcggcggattatgatgtggaggcggcccaacggggtatcgtcttcatcgatgagatcgataagatcgcacgtaagagcgataatccgtctatcactcgggatgtcagcggtgagggtgtacagcaaggtttgctgaaacttctagaaggatcgatcgtgaatgtgcctcctcaggggggacgtaagcatcctgagcaaaagatgattgcggtggatacgaagaatatcctgttcgtttgcggtggtgctttcgatggaatcgaaaagaagatcgctcaacgcttaaatacccgtgtggtcggttattcggctagtttgggtacggctaccgtagaccggaataatttactgaaatacatcaccccgactgatttgaagtcgtttggcttgatcccggagattatcggtcgtttacctatcctcacgtatcttaatccgctggatcgtgatacgcttcgtaacatcttgaccgagccgaagaactccattatcaagcaatacgtcaaattgttcgagatggatggcattaagctgacgttcgatgagaaagtctatgagtttatcgtggataaggcgcttgagtttaagctgggtgcccgtgggttacgttcaatcgtagaagccgtgatgatggacgctatgtacagtatgccatctcaaaaagtaaaggaactccatgtaacgttggagtatgcgaaagagaaatttgaaaaatcggacgtgaaccgtttacaggtcgcgtaaacgtaggcggtttactataaataatacgaagtatggcaaagaaggatcatttaacagaagagctaaatcggcactttggcttcggtacctttaaggggaaccagaaggctattattgagaacgtgctggccgggaaggatacttttgtattaatgccgacggggggaggtaaatccctttgttatcaattaccatccatactaatggaaggaaccgcgatcgtgatatctccgttgatcgctttgatgaagaatcaggtggacgcgatgcggaatttcagtgaggaagatggggtcgcccattttatcaattcctctttgaataagtcggctatcgaccaggtgaaatcggatatattatcaggacgtaccaagttgctgtatgtagcaccggagtccttgaccaaggaagagaacgtggattttctgcgtcaggtaaagatctctttctatgcggtggacgaggcgcattgtatctcggaatggggacatgatttccgtccggaatatcgaagaatccgtccgatcatcaatgagatcggtaaacgtccgttaatcgctctgaccgctaccgccacacctaaggtgcagcacgatatccagaagaatctgggtatgatagacgctacagtctttaaatcatccttcaaccgctctaatttgtattatgaggttcgtccgaaaggaacgaatatagaccgcgagatcattaagtatattaaagccaacgagggtaaatcgggtatcgtatattgtttgagccgtaaaaaggtggaggaatttgccgacatcttgaaagccaacgggataaaggcgttgccttaccatgcgggaatggattcgcaagtacgttccgccaatcaggatgccttcctgatggaacaggcggatgtgatcgtggctacgatcgctttcggtatgggtatcgacaagccggatgtccgttatgtgattcattacgatatcccgaagagcctagaaggttattaccaggaaaccggtcgtgccggtagggatggcggagaaggccaatgtatcgctttctatgcttataaggacttgcaaaaattggagaaattcatgcaaggaaagcccgtggccgaacaggaaatcggcaaacagttgcttttagagactgcggcctatgccgagacttccgtctgccggagaaaagtgctattgcattatttcggtgaggaatacctggaagataattgtggtaattgtgataattgtttgaacccaaagaagcaggtggaagcgaaggaattgttaagtgcggtactggaggttatcagtacgttgaaagaaaagtttaaggcagattatatcgtaaatattttggtaggtaacgaaacctccgaaatccaaaattacaagcacaatgaattagaggtcttcggttccggacaggacgaggatgataaaacttggaacgccgttattcgccaggctttaatcgctggctatttagcgaaggatattgagaattatggtttgctgaaaatcacggaaaaaggtaaggagttcatgaagaagccggtatcgttcaagattaccgaggacaatgaattcgaggaagaggaagaggaagttccggttcgtgggggagcctcttgtgcggtagacccggttctttattccatgatgaaggatttgcgtaagaaattatccaagcggttggaagttccgcctttcgtgattttccaagatccctctttggaggctatggctactacttatccgatcacgttggacgagttgcagaatatcccgggagtgggcgctggtaaggcgaaacgttatggcaaggagttcattgagttgatcaagaaacatgtagaggagaacgagattgagcgtccggaggatttgcgcgtacgtacggtcgctaataagtccaagttgaaggtctcaatcattcagcggatcgaccgcaaggtggcgctggacgagatcgcgttgactaacggacttgagttcaccgagcttttggatgagatcgaggcgatcgtatattccggtacacgtatcaatatcgattatttcttgaatgatgtgatggatgaggatcatatcgaggatatttacgagtatttcaaggactcggagaccgacggtctggaagacgccatcgaggaattaggcggtgactatacggaagaggagattcgcttggtccgtatcaagttcttgtctgaaatggcaaactaatggaagggtggcccggttccactctaaagaaaaaacaaataaagaagcttattgttccttccgaaagagatttatttttccttcggaaggaattttgttttcgttcggatgaaagtttattttcttctgaatcgaatttttaatttctcccgtatcgatttattgcgtgaaaagtcgtatatttgcacgcaataatttttaaagcataagttctatgtcatttattgcagacagggtcgttatggatgggttaacgtttgacgatgtattgttaatcccagcttattcggaagttcttcctcgtaatgtcgatctcacgacaaagttttcacgtaatatcacattgaatataccgatggtatcggccgctatggatacggttaccgaggccaagttggctatcgctatcgcccgtgagggaggtattggtgtgattcataaaaacatgacgatcgccgagcaggcaaagcaggtccagaccgttaaacgtgcggagaatggaatgatctatgatccggtgactatcacgaagggcaaacgtgtggcggatgccttggcaatgatggctgaatataagattggcggtattcccgtggtggatgaaggcgggtatttggttggtatcgtgacgaaccgtgacttgcgtttcgaaaaggatatgaaccgctctatcgatgaggtgatgacgaaagagaatttggtcgtaaccggacaatctacggatatggaggccgccgctcagatccttcaggaacataagatcgagaagttaccggtggttgatagccataataagttgatcggcttgattacctataaagatataacgaaagcgaaagataaaccgaaggcttgcaaggattcgaaaggtcgtttgcgtgtagctgccggtgtaggcgttacgttcaataccttcgagcgtgtagccgctttggtggatgccggggtggatgctttggtgatcgacacggcacatggtcactcaaaaggtgtggtggatgtcttgaaacagattaaggcgcaatatccgcatattgattgtgtggtcggtaatatcgctacgggcgaggctgctaaatatttagtggaagccggggcggacgccgtgaaggtaggtatcggtccgggttcgatttgtacaactcgtgtgatcgctggtgtgggtgttccccagttgtcggctatttacgatgtggcgaaggcgttggaaggaactggtgtgcctttgatcgctgacggtggcttgcgttactccggtgatatcgtgaaggcgatcgccgctggtggatcttccgtgatgatgggatctctgttggcgggtgtagaggagtcgccgggcgatacgattatcttcaatggccgaaagtttaagtcttaccgtggaatggggtcgttggaagctatgcaaaaggggtccaaggatcggtatttccaagatgtggaggacgacgtgaagaagctggttccggagggaatcgctgcccgtgttccgtttaagggttctttgtatgaggtcatttaccaaatggtaggtggtttacgtgcgggaatgggttattgcggggctcataatatcgaggagttgcataaagctcgttttactcgaatcaccaatgcaggtgtgcaagagagccatccgcatgacgtagcgatcacgcaagaggctccgaattatagccgcggtgaatagtaatacaagttttacgttttataaaaaacactaatttaatgggatagcatacttttcttgtcggctctccgttagattagtgttatttttgtaatgtatattcgtgctatggtaaaagaatttttgatgaaaaagttacttatttcattaggggtattcgcttgtgtgacagttaacgctcaaaccgcatccgattcggtcgttatgatggtcgctggaaaacaagtgcctttatctgaatttatttttatcgcagagaagaatggagaggtggatttatcgaatacaaagtccgtcaaaaactatgtcgagctatttaaaaattttaagctaaaagtagcggaggcggaatctttagggatcgaccagacatcctcattcaaaagtgagctggatggataccgggctcagttgatcgatagctatatgtcggataaggagggtgagaaagcggctgcccgtgcggtatatgaccggggggatcactcggtagagttgacccacatcttattccgtttgccggagaagacggtctccaaagatacggtagctgtatatcaagaagccatgcgagtatacgaacgtctccagaaaggagaagatatggaaacagtcggaaaagctttggccgagaaggacaaggagcatgtcgcttgcgaatatgtacgttgcttgctcccgatgcaatccctgaaagtgttcgaggatgccgcctattctttgccgattggcgtggtgtctgaacctgttcgcacgaaattaggatttcatttaataaaagtccatagccgcaaacctaatccgggacgggtacgtgtcgctcatatcttgatcgcattcccgaaagattccgctattcaggactcatcggcttttctggcaaaagcgcaagctgtctataagcaagtacaagagggtgcggatttcggtgagttggcgaaagagtattcgggggatgcggcttccgctaaaaaagggggggtattaccttggttcgggatcggcgagatggtccagccttttgagcaagccgcttttgcgttgagcaagccgggtgatttatccggggtggtggaaactcgttttggttaccatatcattaagttgatcgataagaagggacgcccttcgtttgaggaagaggaaaaagccttgtcgagacgtatggggcagggtgaacgtaacttcgagttatataaagctttcgacgatcgtatgaaaaaagaatacggatacgttttctatccggaagcctatgcggagctgcaagcgttatgtaatgattgtttccccacggacgaggcgttttatgagaaagcgaaggatatgaacaagacgcttatgcaattggatggaaaggatttcccgcaagcggagttcgcttattatatccaacgttgcccgttctcgacaaaaacgtatgcgggtgattttatgcaagaggtctatgatttgtttatccgcgatatcgtaacgaccgccgagcgtaagaatctggagacaaaacatccggagatccctcatttgatgcaggagtaccgggatgggattctgttgtttgaggtcagcaaccgggagatctggagcaaaccctccgcccagcagaaggtgttggaagcgaagtggattgcggatttgaataaaaaatatccggtgactgtcaactggaaattattgaagaaactaaagaaataaaataaagatagatatgaggatagtcttcatgttcctagcgttcgttgtgttgttgggtgcctgtaaaggttctcagccagctgatactacggatgtcttggttagcgtgaaaggacgtaccctaaatcgttcggaggtgaataagctaataccccgggggatttcctccgctgatagtctgttgctggccgagagctttaccaagaaatgggtaaaggatgtattggtgtacgatgtggctttgcgtaacttgggggatgagaaagaggaggtcgataaattggtagaggagtacaggcgttccttggttcgttaccgttatcaggaacgattggtggaggagaagctgaaaactgatatccgggaaagtgataaattaaactattacgaggaaaaccagaaaaagtttatcttggataaaggcttgatcaagggattattcttgaaaatcccggttgatgccccgggacttaccgacgtcaaaaagtggtacaaatccacagatgtggcctctttagaaaaaattgagaaatatagtgtgcaaaatgccacgatttatgagtacttttacgacaaatgggttgatttcgatgaggtaatggataatataccgatccatgtgtcgaatccgaatgcgtttctgaaggcgaataagtatgttgaggtggcggatagcagttattgttatctgttgaatatcaaggaatatttaccttccggcagtgtggagccatatgattatgccagtccgcacgtcacggaaatgctggtcaaccaacgaaaagttgaattcttgaaaaaatttgaagacgagttatataacgatgcgatccggagcggtgacgtggaattccattccgagccgtgatctctaattttataaatgggtagacatgatgaaaaagattttaagtgtattctttcttgcctgttgttcttgcattgtaatggcgcaagacaatgtgatcgatgaaattgtgtgggtggtaggagatgacgctattttacgttcggatattgagacgcagcgtttgtataatcaaaacgagggggtccgtttggatggcgacccgtattgcgtgatcccggagcagatggcgatacagaaactatatctgaatcaagcaaagatcgatagtatcaccgtgaacgagaaccaagtgatccagagcgtggatcaatggatgaacatggctgtgaaccaaatcgggtctcgcgagaaattggaggaatatttcggtaagaaattttcccagatcaaggatgagcgtaaggagatggtgcgggagcagcaggtagtgcaacagatgcagcatcaattgatcggcgagatcaagctgacaccttccgaggtgcgtaaatatttcagccagttgtctcaggatagcctgccgaacatccctacgacagtagaggtgcaaatcgttaccttggaaccgaagattccgtttgaggaaacagacgctatcaaggcccgcttacgtgatttcacggagcaggttaattccggcaagatggaattctccacgttggcccgtttgtactcggaagatccgggttcggcgtctcgaggtggtgagctgggtttcatgagcaagacacagctgttgccggagttcgcgaacgtcgcgttcaacttgaaagacccgaaacgtgtctcccagatcgtacagacggagtatggttaccatatcatccaattgatcgagaagcgtggagaccgtattaactgccgccatatcttattgaaaccgaaggtttccgataaggagttggcggatgctaccactcgtctggattcattgtacaatgatttgcaggcgaataagttcacgtttgaggaagccgctacattcgtctcttacgacaaggatacacgtaataataagggtttgatggtaaaccaagattacgagagcagcaatatgggaacccctaagttcgagatgcaagaacttccacaggaaatcggtaaggtggtatatgacatgaaagtcggagagatctccaagccttttaccatgttgacgaacaagcagaaagaggtagtagctattgttaagctgaaagctcggacggaaggacataaggcgaatttggccgatgacttccaagctttgaaagcgatcgtagaggctaagaaacgtgaggaattattgaacgactggatcacgaagaaacaaaaatcaacctatgtgcgtattagtgacggttggaggaattgtgatttcaaatatccgggttggattaaggaatgagactaattaacaggttatttctagcgctcttatcgtgtgctttatcggttggcgtatttgcgcaaacgcaagatagcacggtggtagccgccaaagatagtgtcgctcccaagaagacgaaggtctttttggagcatgcgaatacgctttcgttcgataaggagaggaacgccgaggctcaagtactgaatggtgatgtttgttttcgccatgatagttcgtatatgtattgcgatagcgcatatttctttgagcagaccaattccttggaagcgtttagtaatgttcggatggaacaaggggataccttgttcgtgtatggaaattacctgttttacgatggaaatacccagatcgcttatttgcgggagaatgtccgcatggagaatgggcaggttaccttgtttacggatagcttgaactatgagcgaatcccggatatcggatattatttcgacggaggtctgattgtcgattccttgaatcagctctcttctttttacgggcaatattcgcctagtacgaaattggctatcttcaatgatagcgtccgtctggagaatgagcaattcacgttgtattccgataccttgcattataatacggactcgaagatcgccacgatactcggaccatccattatcgtgtcggatagcggcacgatctattcttccaggggttggtacgataccgtgaataatacctctttgctattggatcgttctcaggtggtttccggcgaccgtatcttgacgggcgactctatcgcctacaaccgggaactgggttttggggaagcgttcggtaatatgagtctgcaagacacggcgcagcatgtcatgctggaaggccaatatggcttttacaatgagaagaccgagtatgctttcgctacggatagcgcccgtttcttggaattcagccaaggggatacattgtttctgcatggtgataccttgaagatgactacggtggactccctttaccgggaagtaaaagcttattacggcgtccgtttctatcggacggatatgcaaggtgtttgcgattcgatgcagtttaatacaagagactctatattatatatgtatacggaccctatcgtttggaatgaacagtatcagatctatggggatacgatcttgatatttatgaatgatagctcgatcgatttcgctcacgtgaagcaattcgctttcgcgatacagcaaatcgattctactgcgttcaatcaattaaagggaaatgacttgaaggcttatttcgagggacaggtcgtgaatcagatcgatgtgtcgggcaacgccgaatcgattttcttcccattggagaaggacggttcgatggtcggcatgaacgagaccaagagcggtttccttacgatctggctaaaagacaataagttggataaactgaagatctggccgactccaacaggtacgatgacccctattcctgatttgaagcccgaccagaaatacttgaaagacttttattggtttgattatatccgtccgaaagataaggatgatatttatcaggtcgtgaaaagaaaagctcaagatgctccgaaaagaagcaataaattcgtacattagcgtcgtattcataattaataggtaaagctatggcacttttctcgttttataacatgcgtaaaccgcgtcaatatgatcataagcctatttattgggacccccataaggaagccttggaggaacgtataagtaaggtcaaacgtgaaatgggtgtagaggaatcgttggaggaatataagccgcatatcaagggaacttttattgaaggcacctcacatttgaagagaagcgtggggcggggcgaggattcccgggctcgtaagtataagaatgtgaaactggcggtagccttggctgtcttggctgctttcttttggtatttgttctggtaatgagcgatatcattcatttacttccggatcatatcgccaatcaaatcgcggcgggagaggtgattcaacgtccggcctctgtcgttaaagagttggtcgagaatgcggtggacgctggcgcttccaatatccaagtgaacattaaggatgcgggtaagacattgatacaggtgatcgatgacgggaaaggtatgtccgagacggatgctcgcatggcttttgagcggcacgctacttctaagatttctacggccgaggatttattctctttgcatacgatgggtttccggggtgaggcattggcctctatcgccgctgtcgcccatatagagttgcgtacccgggctaggggggcggagcttggtacctgcctgtccatcgcggggtctaacttggagagtatcgagccggaggcttgtaacgagggaagtatcttctcggtaaagaatcttttctttaatgttcccgcccgccggaaattcttgaagtcgaatgagacggaattccggaatatcatcaatgagttcgagcgaatcgccttggtgaatccgcaggtgggtatgtctctttatcataatgacgcggagatattcaatctgcccgagtcggggttacgtcagcgcatcattaatatatatggtaagagtttaaaccagaagttgctctctctggatgcccaaagttccatggtgactatttccggtttcgtggggcgtccggactcggcgaagaagcgaggggcattgcagttcttttttgtgaatggtcgttatatgaagcatccttatttccataaggcgatcatgcaggcctatgagcaattgattcctgccggggatatgccgaattattttgtttatttcacgttggatccctcctcgatcgatgtcaatatccatccgacaaagacggagattaagtttgagaacgagcaaccgatctggcagatcttgatggccgctacccgggaggcgttggctaaatcgagcgctatccctacgattgatttcgacgtggaggatgcgatcgatattcctgtttacaacccggtcaagaaaagtgagcctagtacttataaggccccgaaagtgcaagtggattccagttataatccgtttgacactacttcctataaaaaaccggaattcgattggtctaaattatatcaagggtttgagaacgatcgagtggctgcccaactggagtccgagagtttcgaggatgccccgatcgaggaattgccggccgaggcttcgaacccggaaaacctgtttacggaggtaagcaatccttgctatcaatataaaggacgatatatcgtgacatccttgaaatcgggtctggcgattattgaccagcatcgtgcgcatgtgcgtatcttgtttgaccaatacctgtcgaatatccgtcagcagcaaggtgtatcccaacaagtcttattcccggagatcgtagagtttaccgctgccgaggcggctgtactgccttccttattggaggatttgcgcttcgtcggctttgatctgagcaatctgggaaatgacaattacgcgatcaatggcctgcccgctggtatagagaaccttgatccggtgaacttggtaaaggatatcgtggaccgggcgatcgagaccggatgcgaggtgcatgagaagatctgcgaagccatcgccttgtctttagcgaaagccgccgctatccgtcccggcaaatccttatcctcggaagagatggatcatctgatcgcctccctattctcttgtccggactcgaacctgaccccggatggaaagacgattatctccatgctgacagatgaggagctggagagaagatttaagtgctagggatgatttcgatgacataggtttcactggccgcatttgcttgtgctacagctaaatcctgtgaaacgtgtgaagggtgagcggcactacttgataaagattgccgtagcgggtgtgtttacgctctatatggagggcggtcagtacctttccgaaattgcttgccgtgctaccgcgcatggctgctgggttcttttcctttaatatctggaaaatggaggcagctgatagtggatgtacatttaggtctcccggacatgcggcccggaagcaggcgtggaacacatcttcctcgatcggacgtttatagaaagcctcattcgatcacatgatcgcctcctcctctccggaggtgaaccaatggcgctctcctttttgtaactcgtctttcagctgggcgtagatttgatcatgctcgataccttcgcaattaatcttgctttgcacctccacgcataggaaacggcggcttcccgtggggtcgcttaataggttcttctggttcgtagtgccaataaatgaggctaggcggggtagggggtggaaatgcttggcgtgtgccttgcgtacgttcatcccggccatctgcatccaatttttcagcaaaaccattttacggtcgggcaaccggtcgaactcatcgaggttgatgagcccgaacccatccattgcgaggccaaggcgagcatccagcgatgaaacccctccacccataacggttctgaggagacccgtcgtgccagatcgcttacccggtctttcccgtcccattcgggtaaccgctccatatattgccggaaaggatgatactcttttacttcttttgaatatacgaaacgattcacatcccgatcccagcaatcgatccccgtccgtcttgcctccatgcaaatgctatttaggtcacgttgcgtcaccggatagaagcgatccgcttctgatcgtttgtatcgatattcagtctcgtcgctcaacaagttgaaacggaactcgatgatttcttggaggaaagtctccagactcttttgaaggagtgagttattgtcgctaaatcgtttggctttaccttcggtttggtgtggtatggtgattggcccgttcggttttaagaagcgaagccatagctggcctaaaaaatccaatacagttttcatgatactatgttttagaggttatttttaccgttttcttctgcgaatataggttgttaacttgaagttttccaaatatttatattatcatttgaaataaaagtaatttgtccaaaatactaggaagaactcttgtttaggtggtatgaatgtaatacctttgttaagtgcctataatcttttcacctatgtgaaaagaacgtatcacaatcatgaaacgatcgtttcacataggtgaaaagatcatatcacccttgtgaaatgactaatagcatacgatgttcttatgaataaccttttaatctcatactagatatatggcagcaaaatatgacttttacaagactccggtatcgaaggatagcatgaagcgtcctcgttttcacgcacgtatcgtatcatctggcacgatcgatacggatgatctggccaaacgtatccatggtcgatgtaccgtcacgccggcagacgtagccgccgtgcttatctctttaagcgaggtgacagcggaatatttgcgtgaaggaaaacgtgtacatatcgatgggttggggtatttgcaagtcacgttgcaatgcccggccgtacaatccacgcacgagatacgtgcggagtccatccgtttcaagtccgtggctttccgtcctgaggtagagctgaaagatagcttgaagacgatgacgctggaacgagccaagtacaaatcccattcccgccaattggagcctgagcgcatcgaccaattttgccgagcatgaatatatgacccgtgttgctttccagcggctttgcggactgacgagtagtacggccagccgccgtctgcatcaattcgtcgaggcgggtaaattgcgtgatatcggcacccgccaccagtcgctttacgtggcggctaggtaaatcgtcgatccgatcccattgctttcacaggcttcacaggaactcgtttgatttaaggggattgagtttgtgtgaagcccgtgacgcatgaaacttatcggtaaatagagatagtaaatgttaaatattaataaatacaacaagagcctaccttgccaaacgggaacaaatatgtacctttgcaccgtttttagtgcggagtatacgaaaaaaacaggcacaacttattgattgtccgaaaataatgcgtaactttgcggctcgaaataggaaaagattagataaataataataacacattcaaagtttaaaaaaaagaaagaaatgcctacaattcagcaattagttagaaaaggaagggaaactttggtggagaagggtaaatcacccgcattggacgcttgtcctcaaagacgtggcgtttgcgtacgtgtttacactacgactccgaagaaacctaactctgcaatgcgtaaagtagcgagagtacgtttgacaaatggtaaggaagttaactcctatattccgggagaaggacacaacttgcaagagcactctatcgtattggtacgtggtggtcgtgtaaaggaccttccgggtgtgcgttatcacatcgtacgtggtacgttggatacagcgggtgttaacggccgtacgcaaagacgttccaaatatggagctaagcgtccgaaaccgggtcaagcagcagctgccgcaaaaggtaagaagaagtaattaattacatgccttcaaactgagatttaaatttaagtattaaaacaggtttgagttatttggataggctataaggttgagtaaatggttcagcggaaccgttgaagacaaattaaaggcaaccaacgacaagaacaaatttttgaaaacaaaatgagaaaagcaaaaccaaagaaaagacagatccttccggatcctgttttcggtgatgtaaaggttacgagattcgttaaccatttgatgtatgatggcaagaaaaatactgccttcgaaattttctattccgctttggaaaccgttaagggcaaattgcctaacgaggaaaagtccgctctcgaaatttggaaagctgcgcttgataacattactcctcaagtcgaagttaagtcacgccgtgtaggtggtgctacattccaagtccctactgaaatccgcccggatcgtaaagagtcaatttctatgaagaaccttattatcttcgcacgtaaacgtggaggtaagactatggctgataagttgtctgcagagattgtagatgctttcaataaccaaggtggcgcattcaaaagaaaagaagatatgcaccgtatggctgaggctaaccgtgcgttcgctcacttcagattttaattttttaaggcaataaaaagaatatggcaaacaacgataagcaattgatgttcactaggaacatcggtatcatggctcacattgacgctggtaagacaacgacttctgaacgtatcttgttttacacaggtttgacacacaagatcggtgagactcatgatggtactgctacaatggactggatggcgcaggagcaggagcgtggtatcacgattacttccgctgctacgactacattctggaactatttgggcaaccgttataaaatcaacttgattgacactccgggacacgtagacttcacggttgaggttgaacgttctcttcgtgtattggatggtgctgttgctacattctgtgccgtaggtggtgttgagccccagtctgagactgtatggcgtcaggctgataaatataatgtacctcgtatcggttacgttaataagatggaccgctcgggtgctaactactatgaggtagtacgccaattgaaggacgtattaggagctaatccttgtccgatccagatccctatcggagctgaggagactttcaagggtgttgtcgacttgatcaagatgaaggctatcttctggcacgacgagactatgggtgccgagtatagcgttgaagagatcccggcagacttgcaagctgaggctgaggaatggcgcgataagatgcttgaggctttggctgagtgcgacgacgctatcatggagaaatacttcgatgatccttctacgatcacggaagaggagatcatggttgctatccgcaagggtacgttggctatgcagatcaacccgatgacttgtggttcttctttcaagaacaaaggtgtacagactttattggatgcagtttgcgcgtttttgccttctcctgaagatactccggctatcgagggtacggatccttcagatcctgataaaataatcactcgtaaacctttgttcgaggagccgttgacggcgttggcatttaagatcgctaccgacccgtatgtaggtcgtttgtgcttcttccgtgtatacgcaggttctatcaacgctggttcttatgtgttgaacactcgttccggaaagaaagagcgtatctcgcgtttgttccagatgcactctaacaagcagaacccgatggaggtgattggttgtggtgatatcggagcaggtgttggtttcaaggatatccgtacaggtgatacgctttgcgacgaaaaccatccgatcacattggagtctatggaattcccggaaccggttatcggtatcgctgtagagcctaagactcagaaagacatggataagttgggtatgggcttggctaagttggccgaggaggatcctactttccgcgtacagacaaacgaggagacaggtcagaccgttattagcggtatgggtgagcttcacttggatatcatcatcgaccgtttgcgtcgtgagttcaaggttgaatgtaaccaaggccgtccgcaggttacttataaggaggctatcacgcagccggttgagcttcgcgaggtttacaaaaagcaatctggaggtcgtggtaagttcgcagatatcatcgttcgtatggagccggcagacgagagcttcgagggtactttgcaattcatcgatgaggtgaagggtggtaacattcctaaggaattcatcccgtccgtacagaaaggtttcgagaaggctatgaagaacggtgtgttggctggttatccgcttgacaagttgaaagtgactttgatcgatggttctttccacccggtagactcagaccagttgtctttcgagatcgctgctatccaagcgttcaagaacgcttccgctaaggcaggtcctgtattgatggagccgatcatgcagatggaggttgttactccagaagagagcatgggtgacgttatcggtgacttgaacaagcgtcgtggacaagttgagggtatggagactagccgtacgggagctcgtatcgtgaaggctaaggttccattggctgagacattcggttatgtgacagctttgcgtacgattacttcaggtcgtgctacatcttcaatgcagttctcacactacgctcaagtatcctcttctatcgctaagcaagtattgacagaggtgcaaggtcgcgttgatttgatcaaataatatttagaaacatataataaatatgagccaaaagatcagaattaaattgaagtcttacgattattctctggtagacaagtctgccgagaagatcgtaaagacggtaaaggctacaggtgctatcgttagcggtcctatacctcttcctacgcacaaacgtatctttacagtgaaccgctctactttcgttaacaagaaatctcgtgagcagttcgaactctcttcttataagagattaatcgatatctatagctcaactgcgaagacagttgacgctttgatgaagctagaattacctagcggtgtagaagtagaaattaaagtgtaagtttttaacaattagtgaaatgccaggattattaggaaaaaaaatcggaatgacatccgttttcagtgccgagggaaaaaatcttccatgcactgttatcgaagtgggtccttgtgtggttacacagatcaagactttggagaaagatggctatgaagctgtacagttgggtttccaagagaagaaagagaagcacacgacacagcctgagatgggtcacttcaagaaagccggtgtagcacctcaaagacacttggccgagttcaagaatttcgaaactgagtacaagttgggtgacgtgatcactgtagacttcttggaagacgcaggtttcgtggatgtagtgggtacatcaaagggtaaaggtttccaaggtgtagtaaaacgtcatggttttggtggtgtaggtcagactactcacggtcagcataaccgtgctcgtaagccgggttctatcggtgcttgttcttaccccgcaaaggtatttaagggcatgcgaatgggcggccagatgggtaacgaacgtgtaaccgttcagaatcttcaagtgatcaaggtaatgccggaacacaaccttttattggtaaagggatctgttccaggagcaaaaggttcaatcttattaattgaaaagtaatggaactgagcgtatttaatattaaaggtgaagataccggaagaaaggtaactttgaacgatgcgatcttcggcattgaacccaacgatcatgctatttacttggacgtaaagcagtatttggcaaatcaacgtcagggaacgcataagtctaaagagagaagcgaagtatctggtagtacacgtaagctgatccgtcagaaaggtggtggtggcgcacgtcgtggtgatatcaactctccggtgttggttggtggtggccgtgtattcggtccgaagcctcgtgattatgagttcaagctgaacaagaaagtaaaatctttggctcgtaagtcagcattgagctacaaggcaaagaacaatgcgattgttgtcgtagaggatttcacaatggaagctcctaagactaaagaatttataacaattgctaaaaacttgaaagtggctgataaaaagttacttatggttttaccggagaagaataatttagtatatttgtccgctcgaaatttagagaaggcaagtgtaataactgcttctgaactaaatacatacgctgtgttaaacgctgttaatttggttttaacggaaagttcagtcgctgttgttgaacaaaattttaaagcataaggagtagaataatgggaattattattaagcctatagtaactgagaaacaaacagcgatcacagagaaatttccgaatcgctatggttttcgtgtttctcctgatgccaacaaattggagataaagaaagctgtagaggacatgtacagtgttacagtagttgatgttaacaccatcaactactctggaaagcgtaaaagccgttatacaaaatcaggtatcatcaacggcaagcaagctgctttcaagaaagcgatcgtaacgttgaaagaaggagaaacaattgatttctttagtaatatctaaaaagagaaatgggaatacgtaaattaaagcccacgacaccggggcagagacacaaagttattggtgcatttgataaaatcactgcaagtacaccagagaagtctcttgtagtaggtaagaagagtacaggtggacgtaacaacactggtaagatgacaatgcgttatatcggtggcggtcacaaacaaaagtacagaattatcgatttcaagagaaacaaagatggcattcctgcgacagtaaagtctatcgagtatgatcctaaccgttcatctcgtatcgctttgttgtattacgctgacggagcaaagagctatatcatcgctccgaacggattggaagttggccaaacagtggtttcaggtagcgacgccgctcctgaggtaggtaatactttgcctatggcaaatattcccgttggtactattattcacaatattgagcttcgtcctggacagggtgccaaaatggtacgttccgcaggtgcattcgctcagctgacttcaaaggaaggcgcttatgcgattattaagatgccttctggtgaaactagaaagattcttgcggcttgtaaggctacaattggcgcagttggcaactcagaccatgctcttgaaaaatcaggtaaggccggtcgctctaggtggttaggtcgtcgtcctcgtaaccgtggtgttgttatgaacccggttgatcacccaatgggtggtggtgaaggtcgttcttccggaggtcatcctagatcccgtaatggcttatatgctaagggcttgaagactagagctcctaagaagcattcttcaaagtatattattgaaagaagaaagaaataatctgattaattaagtaaactatgagtcgttcgctaaaaaaaggcccgtatattaatgtaaagcttgagaagaaagttctggcaatgaatgagtcaggaaagaaagccgtagttaagacatgggcaagagcttcaatgatttcgcctgatttcgtaggccatactattgcagttcataatggaaataaatttattcctgttttcgtaaccgagaatatggtaggtcacaagttgggagagttctcaccgacacgtactttccgcggtcacgccggtaacaagaagaaataatatcggtagtaacaggaattcaggaatctgaaaataaaaagaatcgaataaaatgggtgctagaaaaagaatatcagctgaagcaagaaaagaagcccaaaagaccatgtatttcgcgaagttgaacaatgttcctacctctcctcgtaagatgcgtttggtagcagacatgattcgcggtatggaagtattccgtgcgcttggtgttttgaagttttctaacaaggaagctgcagcaagagtagaaaaattgcttcgttcagcaatcgcaaactgggaacagaaaaatgaacgtaaagcagaagctggagagttatgcgtatcttcaatcagcgttgattgcgctactacgttgaagagaatgcgtccggctcctcaaggaagaggttacagaattcgtaaacgctcgaaccacgtaactctgtttgttgatacacttagtaaaaacgatagtcaaaattaatttgtagatgggacaaaaggttaatccgattagtaatcgtttaggaattatccgtggttgggattccaattggtatggcggtaagaattacggggatactttgctggaagatagcaaaatccgtaaatatttgaatgcccgtcttgcaaaagctagtgtatctcgtatcgttattgaacgtacgcttaagttgatcacgatcactgtttgtacgtcacgtccgggtatcatcatcggtaaaggtggtcaggaagttgataagttgaaggaagagttgaagaagatcactgataaagaagtgcagatcaacatcttcgaggtgaagagacctgaattggacgctgttatcgtagcaaacaacatcgcacgtcagcttgaaggtaaaatcgcatatcgtcgcgcggtaaagatggctatcgcctctaccatgagaatgggcgccgagggtataaagattcaaatctctggtcgtttgaatggcgctgaaatggctcgttcggaaatgtataaggaaggaagaactccgttgcacactcttagagcagatatcgactatgctttggctgaggccttgacaaaagttggtttgctgggtgttaaggtttggatctgtcgtggtgaggtttatggcaagcgcgatcttgctccttctttcactgctgccaaggagacaggccgtagaaacgacaatgccggtggcaacagagacaagaacttcaagagaaaaagagctaatcgttaaacgttagaatttaagtagagatgttacaaccaaagaaaaccaagttcagaagacagcagaaaggtcgcatgaagggcgaagctcaacgtggcaaccagctggccttcggttcttttggaataaagtcattagagaataaatggattaccggtcgtcagatcgaggctgcccgtatcgccgttacacgttatatgcaacgtcagggtcaggtttgggttcgtatcttcccggataagccaatcacgaagaagcctgcagaggttcgtatgggtaaaggtaaaggtaatcctgagggatttgttgcgcctgttactccgggtcgtctgattttcgagatcgaaggtgttccctttgatatcgctaaggaagcgttgcgccttgccgcacaaaaacttccggttacaaccaagtttgttgtgagacgtgattatgacatgcaaaatcaaaatgcgtaattgttatgaagattgcagaaattagagaactaagcacgaaagagttgctagagagagtagatgcagaggttgcggcctatgatcagaagaagattaaccatagcatctcgcctatggataatccttctcagattaaacagcaacgcagattgattgcgcgcatgaaaacagaattgcgccagagagaacttaacaacaaataattgagcctgatggaaactagaaatttaagaaaagaaagaacgggcgtggtaacgagcaacaagatggataaaagcatcacggttgccattaaatggaaggaaaaacaccccatttatggaaagttcgttaataagacgaagaaatatcatgctcacgacgaaaataacgaatgcaacattggcgataccgtaaagattatggagactcgtcctttgagcaagactaaaagatggagattagttcaaataatcgaaagggctaagtaagatgatacaacaagaatcaagactagtagtagcagataacagtggagctaaggaagctttgtgtatccgtgttttgggcggaacgagaaagcgttatgccactgtaggtgatgtgatcgtagtagcaatcaaaagcgtaatcccagctagcgacgttaagaagggtgctgtttctaaggctatcatcgttcgtactaagaaagagatccgccgtccggatggttcttatatccgtttcgatgataacgcttgcgtattattgaatgccggtggcgatatccgtggtagccgtatcttcggtccggttgccagagagcttcgtgcaacaaacatgaaaattgtatcacttgcacctgaagtgctttaatctcgtaaaatttaaagtaatgagtaaattacatatcaaaaaaggcgatatagtatttgttaatgccggcgaggacaaaggtaagacaggtcgtgttttacaggtacttgtaaaagataatcgtgcgattgtcgaaggtattaatgtggtatcaaagcataccaagcctaatgcgaagaatcctcaaggaggaatcgaaaagaaggaagctcctattcatctttctaaccttaacgtggttgacccgaaatctggtaaagctacacgtatcggccgtaagttgaatgagaagggtgctttagtgcgttattctaaaaaatcaggggaggaaattaagtaatgagcaatactgccagtcttaagaaagaataccaagacagaattgttcctgccttaacgaaggagttcggttacaaatccgtgatgcaggtacctgttttgaagaaaatcgtgattaatcagggattaggtatggctacggctgacaagaagatcatcgatatcgctatcagcgagttgtctacgatcaccggtcaaaaagctgtcgctaccgtatctaaaaaggatatctctaactttaagttgcgtaagaagatgccgatcggtgtgatggtgacattacgtcgtgagcagatgtacgagttcttggagagacttgttcgtgtcgctcttcctcgtatccgcgacttcaagggaattgagagtaagttagacggaagaggcaattatacactcggtattcaggaacaaatcatttttcctgaaataaatatcgataatattaccaaaatattgggaatgaatattacctttgtgacctctgcgaaaacagacgaagaaggttatgctcttttgagagaatttggattgccttttaaaaacggaaaaaaagactaagtagttatggctaaggaatcaatgaaggcccgtgaggttaaaagagcaaagcttgttgctaagtatgccgctaaaagagctcagcttaaggcagaaggtaactatgaggctttgcaggctttacctaaaaatgcttctcctgtacgtttgcacaaccgttgcaagattacaggacgtccgaaagggtatgtacgccagttcggtatttctcgtatccaattgcgtgaaatggcatctaatggtttaatcccgggtgtaaagaaagcaagttggtaagagtttttttagtttaaatattgtccgggtggccggatcaatttaattaattatttatatgacagatcctattgcagattatttgacaagattgcgtaacgcaatcaaagcgaagcacagagttgttgaggtgccggcgtcaaatttaaagaaagagatcactaagatccttttcgacaagggctacattcttaattttaagtttgtagaggatggtcctcaaggtacgatcaagatcgccttgaagtatgacctagtaaacaaagttaatgcgattaagaaacttgagagagtttctacgcccggtttgcgtaagtacactggttacaaagaaatgccgagagtattgaatggtttaggtattgctgttctttctacttctaaaggtgtgatgactgacaaagaggcccgcgatctgaagatcggtggcgaggtattatgttacgtttattaattaggagggaagaagaatgtcaagaataggaaaattaccaattcatgtaccggctggtgttacagttacaattaaggataatgtagtaacagttaaaggccctaaaggtgaacttgtacaggaagtgaatcctgatattaacgttactttggaagacggagttatccatttaacaagacctactgatgataagaatcatcgtgcgttacacggtttgtatcgctctttgatcaacaacatggttgttggctgctcagagggatataagaaggagcttgagttagtaggtgttggttaccgtgtttcaaatacaggtcagttattggatctttctttaggttatactcacaatatctatttgcagttgccgaaggaagtgaaagttgagacgaagtctgagagaaataagaaccctcttattatccttgaatcggctgacaaacaattattaggtcagatttgcgcgaagatccgttcattcagaatgcctgaaccgtataaaggtaagggtattaagttcgtgggtgaagagattcgtagaaagtctggtaagtcagcaggtaagtaatctacgtaaactgaaattatcatgacaacgaagctagaaagaagattaaaaataaaagcaggcgtacgcggcaaaatctcaggaactactgagcgtccgcgcctgactgtgtttagaagcaacaagcaaatctacgcacaggtgatagatgatactacaggcaagactttagccgctgcttcatctttgaaattagatgttaaggctccgaaaaaggagatcgctgctaaggttggtgaattaatcgctaaaggcgctcaggaagctggcgttcagacagtggttttcgaccgtaatggttacctgtatcacgggagaattaaagaattagcagatgctgcacgtaacggcggccttaaattttaatgaagatggcaaataatagagttaaatcgaccaacgacttagagttgaaggacagactggttgcaatcaaccgtgtaactaaggttacaaaaggtggacgtacattcagttttgctgctatcgttgtagtaggaaacgaggatggtatcgttggctggggattaggtaaagccggtgaggtaacgacagctatcgctaaaggtgtagaagcagctaagaagaacttgatcaaggttccggtacacaaaggtacgatccctcacgaacaattagctaaattcggtggtgctcaagtgctgattagaccggcatctcacggtaccggtgttaaggctggtggtgctatgcgtgccgtattggagagcgtaggtattacagacgttttggcaaaatctaaaggttcttccaaccctcataacttggtgaaagctactatcgctgcgctaggtgagttgagaagcccgttcgatgttgctcagaacagaggtgttgctgttgaaaaagtatttagaggttaattagggaggataagtttatggcgactattaaagtaaagcaagttaaaagtagaattaaatgcccgaaagaccaaaagagaacgcttgacgcactagggctgagaaagatgaaccagattgtagagcatgaagctaatccggcgatcttaggtatggttgagaaagtgaaacatttggtttctgtagaaaagtaataattggttgaaaaaataaattatacgatatgaatttatcaaatttaaaaccggctgaaggatctaccaagaccagaaaaagaatcggacgtggtccgggttcaggattaggcggaacttcaacaagaggtcataaaggtgccaagtctagatctggctacaagaacaagattggtttcgaaggtggtcagatgcctattcaaagacgtttgcctaaattcggtttcaagaatattaaccgtgtagaatataaagctattaatatcgatactttgcaacaaatggcagaggctaagcaattgactaagattggtattaatgaattgatggaggctggtttcatctcttcttctcaagtggttaaaattcttggtaacggtagcttgaccgctaagttagaggttgaggctcacgctttctctaagagcgcagaggcagctatccaagccgcaggtggaacagtcgttaaactctaagtcatgagagctgttgaaacaatcaagaatatctggaagattgaggatctgagaaatcggatcctcaccactcttttattggtggctatataccgttttggtacgtatgtagtgcttccgggtatcgatcccaaagcgttgaccgctttacaggagcagacaagaggcggattgcttgcactgttggatatgttctcaggtggagccttttctaacgcatctatttttgcgttgggaatcatgccatatatctccgcttcaattgttatgcagttgttagccatcgcagttccttctttccaaaaattgcagagagagggtgagagtggccgtagaaaaatcaatcagtggactcgttacttgacgatagcgatcttgttattccaaggtcctacttacttggtgaatttaagcgttcagcttaaggctgccggcgctgctttaccgggtggtatttggttcacgatctcatctacgatcatcttggctgcgggaagtatgtttatcttatggctaggtgaaagaattacagataaaggtgttggaaatggtatttcatttatcattttagttggtattatagcccgtctgccgcactctttgttccaagaattcgtttctagaacaagtgagaaaaccggtggtctggttatgttcttatttgagatgctgttccttttgcttgttatcgctggtgcgattttattggtacaaggtactcgtaaggtccccgtgcaatacgcaaaaaggattatcggtaataaacaatatggtggcgcacgtcagtatatccctttgaaggtgaatgccgctaacgtaatgcctatcatcttcgctcaggcgatcatgtttattcctatctcaattgtaggtttctctagtacgggagagcagagcggtttttgggctgctttcatggataatacgggattttggtacaacttcgtgtttgcggtgttgattatcctgtttacgtatttctatacggctatcacgatcaatccgacccagatgtcagatgatttgaagagaaacaatggttttattccgggtgtgaaaccgggtaagaataccaaagactatctggataccattatggaccgtattactttgccgggtgcttttttccttgcgttggttgctatcatgcccgctttcgctagaattgccggtgtaagtatggagttctcccaattctttggtggtacatctttgttgattttggttggtgtggtgttggatacattgcagcaagttgaaagtcatttgctaatgcgtcattatgacggtttgttgaagtcaggaagaattaaaggccgtacaggctctgttgccgcttattaatagaatgatctatttaaagacagatgaagagattgagttgatgcgtgaggctaatcaactggtgggtaagacacttggcgaggtagctaagcatattgtccccggagtctccacacttcaacttgataagattgcggaagagttcattagagataatggtgctgttccggcttttttgggatatggtggtttccctaattcaatatgtgcctcagtgaatgatcaggtggtgcatggtattccttcttctaagatgatcttgaaagagggtgacgtgatctctgtggattgtgggacgatattgaatggttttgtcggtgactccgcttacactttctgtgtaggtgaggttgcgccggaagtgaagaaattgttgaaagcgacgaaggattcactttatttaggtatccaatgtgctgttgaaggtcaccgtttgggtgatatcagtaatgcgattcagacttattgcgagtctcaaggttactctgtcgtaagagagctggtgggacatggtataggtcggaaaatgcatgaggaaccggaagtgcctaattatggcagacgtggatgcggaccgttattgcgtaacggaatgtgtatctgcatcgagccgatgatcaacatgggaagcaagaacgttgcatttgagaaagacggatggacggttcgcacaaaggacagaaagccttctgctcatttcgagcattgtatcgctatacgtccggatggtccccagatcttatcttcatttaagtttttagaggaagttctaggagaaaacgcaatttaattggatttatatggctaaacaatcagcaatagagaaagatggagtaattgtagaagcattgtcaaacgcgatgtttcgtgtagaattggagaacggacatgaaattaccgctcatatctcaggaaagatgcgtatgcattacattaagatccttccgggggataaggtaagagtagaaatgtctccgtatgatctatcgaaaggtagaattgcttttagatacaaataaaattaaacacgatatgaaagtaagagcatctttaaagaagcgtacacctgagtgcaagatagtaagaagaaagggtcgcttatacgtaattaacaagaaaaatcctaagtataaacaacgtcaaggataatttattatttttgcaaaataatctaagtaagtaatatggctataagaatagttggtgtagacttgccacaaaataaaagaggagaaatcgctttgacttatatctatggtattggtcgtagcgctgcaaaatccgtattagataaggctggggttgatcgtgatatcaaagttaaggattggacagacgatcaagccgcaaaggttcgtgaagtcattggcgctgagtacaaggttgaaggtgaccttcgttcagaagttcagttgaacatcaagcgtctgatggatattggttgctacagaggagttcgtcatcgccttggtttgcctttgagaggccaaagcacgaagaacaacgctcgtactcgtaagggtaagaagaaaactgttgcaaataagaaaaaagctactaaataataagagttaatatggcaaagaaaacagtcgcagcaaagaagagaaacgtaaaagttgacgcttacggtcaagctcatattcattcttcttttaacaacattattgtgtctttagcgaatagcgaaggacaagtaatcagctggtcttccgctggtaagatgggattcagaagctctaagaagaatactccttatgcagctcagatggcagcacaggattgcgctaaagtagcttatgatcttggtttaagaaaggtgaaagtattcgttaagggtccgggtaacggtcgtgagtccgctatcagaacgatccatggcgcaggtatcgaggtaacagaaatcgttgatgttacaccgcttcctcataacggatgtcgtcctccgaaaaagagaagagtataattaattatagtttcttaaacattgaatccggaattgtgaatagattgcatattgaccttatcctctctgtaatcgcggctgcacggttccagattcaaacagaacatttaaaaaaataaaaaaatggcaagatatactggaccaagaacaagaattgcccgtaagtttggtgaggcaatattcggtgcggataaagttctttctaagaagaactatcctcctggacaacatggtaactccagaaaaagaaagacttctgaatacggtatccagcttcgtgagaagcaaaaagcaaaatacacttatggcgtattggagaagcaatttagaaacttattcgaaaaagcttcacgctctaaaggtattaccggtgaggtgcttcttcaattgttagaaggccgtcttgacaatatggtttatcgtttgggtatggccccgacaagagccgcagctcgtcagttggtttctcatcgtcacattacagtagacggaagtgttgtaaacattccttcttactctgtaaaacccggtcaggttattggtgttagagaaaaatctaaatccatggaggttattgccgacgcattgtcaggcttcaaccacagcaagtatccttggattgagtgggatcagtcttcaatgagcggaaaattactgcatctgccggaaagaactgacattcctgaaaacattaaagagcagttgatcgtagaattgtattctaaataataattgatttccatggcgatattagcatttcaaaaacccgataaagtattaatgttggaagcggacaatttcttcggaaagtttgaatttcgtccgttggaacccggctatggtattacaataggtaatgctttacgtcgtattctcctgtcgtcacttgaaggttttgctattacatccattaagatcgacggggttgaccatgaatttggtacaatcccgggtgttatcgaggatgtaacaaacattatcttgaatctgaagcaagttcgtttcaagcatatcgtagacgacatcgagaatgaaaaagtgagtattactgtttcgggttcggaagtgttcaaagccggtgatattggtaagcaactgactggattcgagatattgaatccagatttggttatttgccgcttggatccgaccgcaagtttccagattgaattgactattaataaaggtcgcggttatgtacccgcagatgagaacagagacccgaacgcagatatgcatgtgatcgctatcgactctatcttcactccgatacgtaacgtaaaatattcaatcgagaacttccgtgttgaacagaagacggactacgagaagttggttcttgaaatagccacagatggttctattcatccgaaggaagcgttgaaggaagcagcgaagattctgattcatcatttcatgttgttctcagatgaaaagattgcgatcgagacagcggatactgaaggcaatgaagagttcgatgaagaagtacttcatatgcgtcagttgcttaagagcaagctggctgatatggacctttccgttcgtgcattgaattgcttaaaggccgcagatgttgaaacattaggtgagttggttaagttcaataagaatgatttgttgaaattccgtaacttcggtaagaagtcgctcactgaacttgatgaactgcttgagagcttgaacctttcattcggtatggatatcacaaaatataaattagataaagagtaagtaaacgatgagacataataagaaattcaatcatttaggtcgtacaaatactcaccgtgacgcaatgctttcgaatatggcttgttctttgatcaagcataagagaatctttactacgacagcaaaggcaaaagcgctacgtaagtatgtagaaccacttatcacgaagtctaaggaggatacaactcactctagacgtgtggtatttagcaatttgcaagacaaatttgctgtaacagagttgttcaaggaaattgctcagaagatcggtgatcgtccgggtggttataccagaatcatcaagactggtaaccgtttaggtgacaacgcagctatgtgctttattgagttagtagactataacgaaaatatgttgaaggatacagccgctaagaaagctcctaaaacaagacgttctcgtaaaaaagcaacagcagcggttactgaggctcctgcagctgaagcagctagcgaggaaaaagcagctgaataagcaagttttttacaatcatataagaaaagcgattcgtatcacacggatcgctttttttgtttattagcgaattgataaatttgatgagttataaggaacattccttgcttggctattgttatatttgtgaaaaagaaaagtaagacatcattgaacaactaataaaacaaatatagtaatatggaaattgtaaaagtagtaggtagagagatccttgattcacgtggcaacccgacagtagaagtagatgtacatttggcttccggcgcatttggtcgtgcggctgtaccctctggcgcctctaccggcgagaacgaggctatcgagttacgtgatggcgataaaaatcgttacggtggtaaaggtgttcttcgtgccgtggataatgtaaataaggtaatcgctcccgccattttaggtatgagcgccttgaatcaaagagagatagaccataagttgctggatttggatggtacaaagacaaaatcaaatctaggagctaacgctatgttaggtgtatcgcttgccgtagcgaaggcagcggctaattatctggatctgcctttatatcgttatatcggaggaacaaatacttatgtgttgccggttcctatgatgaacattatcaatggaggttctcactccgacgctccgatcgcctttcaagaattcatgatccgtccggtaggtgcgaagagtttccgtgaggggcttcgtatgggcgcagaggttttccatgcgttgaagaaagtattgcacgatcgtggcttgagcacggctgtaggtgatgagggcggtttcgctccggcattgaatggtacggaagatgccttgaattctattatggccgctatcaaagccgctggatatgagccgggcaaggatgtgacgatagccatggattgcgctgcttccgagttttatcacgatggtgtgtatgattatacgaaattcgagggtgagaaaggcgctaagcgtaacgcccagcaacaagtcgcttatctgagtgagttggtgaataaatacccgattgattctatcgaggatggtatggacgagaatgactgggccggttggcaaatgctaacctccacgctaggcggaaaatgccagttggtaggtgatgacctgttcgttacaaacgtagagtttttgaagaaaggtatcgagaagggttgcgcgaactccatcttgatcaaggtaaatcagatcggtacattgagcgagacattagacgctatcgagatggcccaccgtaatggctacacatccgtgacttcccaccgttccggtgagacagaggacgctacgatcgcagatatcgccgtagctaccaacagcggacagatcaagaccggctcattgagccgctccgatcgtatggcgaaatacaaccagttgcttcgtatcgaggaggaattgggttccttagctgtttatggttataagacttataagaagtgaaaaaacggggcaagcctactaatcgatagccggcctgcccctaacatttaatgattataaatctattgccctaaataagagagtgaatgttgtatctcttctctagagaccgagaagttcctgttcccggccaatttatttaatacgagtgtgcctatgttttctgcgctttccttatccgggaacgcaattaccgtatcaatagagggaatggtgggttggtaaatcaacacctttccgttcatcctaatctggtacccccagccatcccccgattgaaacgtttgcaactccagttgccgcccgggagaagaccccatttcttcaccccggaaaaaagataaataaaacagtaataccggcagtaccactaggcccggtacgaaccaagcccgtcctttcttagtactcatcatcgtcatattcattcgggtgaagttcccaaatatcatcaaattgagtggtaccacttttgccggatactacgaatcctttctcgccagaggagaaagatgctgtcgccgtacgggcagttcccttgaatttagccacgttttcccatagatcggtggccggataatatttccaagtgtcgctacgtaggcttccgctctcaccgcaagtcagataagcggctccatcaatcacgaaagcaaccccgttcgtacgtgtgatcgtataatcatcgtcataatcctcgtccgaggaatccgatatatccctaagttgggtccatgattccgtgctgggatcgaatttccagaaatcgtctacatattcgccgttattttgtccgcaacatacataagcgattccatttatcacgaagctggtagcgccctgacgctttgtcccgccgatactgatcgtttgcgtccagctatttgccgccggattaaaggcataaaagtcttttaggtaattcccgtcgtatccgcatccgatatacgctttaccgtttaccccgaaggccacggctccatatcggcccgagccggggaaatccgctttctgtgcccacgtattggtggtcgggttaaattcccagaagtcattcaagtaattggtaccgtcgtatccggttcccagatatcccttttcatctaccgccatagctacggccgaattgcgggcggttccgggaaagtccgccttttgcgtccaagtatctcgttccatatcatattcccaacaatccgataaacgattttttccgtcgtttccgcaaatcagatatcctttgttaccgatcgtgaaagaggaggcgtaatttcgcgccaatccgtccatgtcagagacacggtaccacttaccgatcaaatcatcgtcatcatcatcactgcaagcgctgatgatgacaggaagaaaagcgatcaagaatacaagaatccttttgtgtatcattctaactacgtgttttgtttttacggaagcaaaagaacgagggttttacgagacccacaaattaaatcggtaaacatacggtttttatcggtgaataagccggatttataggttagggcctcgaatggttttgaaatcggtttcatcttcagtatcgggccgtttacagaggaaaccggtgggttcatgggtttatcttgccgggttttgcgctaaatacgttctttgccatcggattgataaaagattattcgcttattaaataagaagtatggttagaacattctttgctttggggtgcttgatgctctgtctgggactgttttcctgttatgacgagaacggtacgtatggcagcgatctggtggactccgctttccgtaacgttcgtatagataccagcacggtcgtagtgacctcggtattgatcgactcgttggagacatccggtaagaacgtcgctttggtaggccggtacaaacattcattatggggagtcgtctcgtcgcatagctttatcgcttatgagagaccgagctatgggactgatccggacgagacggtcgtactggactcgctagtcctgtctctcgctttcgatggtcgctttgtaggagacacgaccctccaacaaaccctctcgatttatcagctaacggagaagattgtcttaaacgataacgggtacttatataataatagcagtgtctcttacgctcccgaggctttggcggtctgctcatttaaaccgaagccgaagggcggggagaaactggaagtccgtcttcccgatgcgctagggcaagacctcttgtcccgttttcatgcgcaggatcaagcggtgtccgaggatcgctttgaggactatttcaagggggtggcgatcgtgccggacttggcgggaagcgagtctctgctgactttcacggtagccgattcctccgccgctttagtcctgcattatcatttatccgatgagctttccacggagaaggaattatggttcttcccaaatacggatacccagttcaatcatatcgaccatgaccgtagtggaacggatatggcaggatatccgatgaaaggagtggagataccttcggctgagcttagtaaccggggcgtattattcggaggcttgggttggtatacccgtctggaattcccgtatttgaataatctgatgcaacaaggcacgcaagtggagatcgagagcgctttacttaagatttatcccgagcaaggcacttattcggattacaataccttgccggacagcctctacctatatatcgccgatgagaataatgtagtgacggatgccgtgaccgattatctcggttccgaggttcaacgaggtacgctatcggaagacaatacgtttaacgagaacacctattattatttcgacgtgactcaattcatgcaagaggagctaggtgcctttggcatgtataagcataatcttcagttggtttttaatagtgatgattacaccggtacgttcaagaacttgacgtttaacgatcagggaggacgtaacccggtcactctacaactcatttataaggtctatgaaagttactagataccttctttacccttgcctcttgatggcggcaagcgcatccgcgcagaatacgatgacttcctcgccttactcgatgtttggactgggtgagatggcttccggtttatatggtcaaaatacctcgatggcgggtgtcactgtcggcatgcgggaagggatgctgatgaatatagagaatccagccggattgacggcgttggatagttgtaagttgttcgctgaggcatctgccttcgtgaagaatgaacgataccgctcagacgggagctctagcagcgcattcaccgggaatttctccgctttctcattgggagggcgtatcatgcgacggtggtatatgtccgtcggggtaactccttatagtttcgttgggtattattttaagtcctcgcaagagttggaaggatctcccggaacctttgtaaccagtacgttttcggggacaggcgggctttccaaggctttcctttctcagggatttttattgaccaagcatctatcggtcggtatgaatcttaattttatctttggaaatatgacgcagaatgagatacaaagtgcgatgacagtgtcaagggagatgtccggccgctctttttacgccgatttcggtttacaatatcatcgtccgatcgcccgggaaacctttctaacggtcggcgccatttacggctataagcaacggatctcattgaaaaacacggtgacggtgacgggaagcagcacggaaaccccctataaccagaaaagggtgacacaatatctacctcaatatataggtatcggtagctcattggcgcataagaaatggacgtatgcgttggactatctattccggcaatacggggtattgaactcgagcgatagccgggtaaagttccgggattcgcatgagctgcgcttgggcgtatgctatttcccgaatggatttagctccagcagttattggaaacggatgtcttataaagcgggtgtttctgtttccacgccttacctgcggttgaaaggacaatccggcggggcgtatcgggtaagcgtcggcttgggattacccgtcctgaatggccgtatcaatacggcgttttattacgatcgtctccaattgcaagggaatgcgttgcgaagagatatcatgggctttacggtgacctatacattaagcgagaagttctaccaagtgaagctttagttttctgcctatgaaactaaagtttcttcactaggaaacaaaagttttgtcacggagaaacaaaagtttcttccgcatgaaactcttggttactcttggagagccagattattcatcaaggcgggcaggtacgaatcgctgatagggatcagttcctcgccgatacgtatccgcttgcgctcgatataattaatgtgggagagggatacgatgtaagagcgatgtacccggcaaaaacgattcctgtccagaaactcctcgaaccgcttcaagctgacttgcgtgagcaggggcttgccattgatacggtgtacctttacataatcgccgtacccctcgaggaaaaggatctcttcccggcggaggcggatgatcttgctgccctcccggacgaagatggggcgttctgtttgctccttgctcagcgcttggtgaacatcggccaaagccttgtccagtttctcgaaatatcccatgagcgtgttcagggtcgaggtgtctccgtcgaaagtgatacatttcagcatagtgtttttatctttatttgttgtaccgcaaaataacaggaaagttcggtaaagaaaggttaagcgccgattagtggtataatcgggtcggtgaatcgccttacgggagggggtgaaaagacattattcctcttccctcagaatccatttcttgaagaccggggtcttggttttgctaatgataatacgttcggggacaggtaaagtgaggttgacggacaggcggctcccgaaccaaagatctatatccttgatggcattgcgtgaaatgatgaattgacggttggcccggaagaaaagcctctcgtccagttgctctcccaacgcgtcgagggtacggtctacgggatgttgttttccgtcgaaggtataggcggtaactttctcgttggccgtatagaaataaaggatctcctcaactggtaacggatagaatttatcggccagcatgatcaataagctcttgatcgtgtggcgactctggattgtacggttcgtttgccggatatgcgccagcctttcctcggtatcgaacagccgtaatttattcaaggccctttccagcgaggccagcgtgacaggtttcagtaaataatcgatactgcttacttgaaaagcctgtaacgcatactcatcgtaagcggtcgtgaagactaccggggcatctatctccacctgctcgaatatcttgaacgccgatccatccgctaaatggatatccatgaagatgatatccggatgaggcgatgtccggaaaaactccacgctctcttcgatactctccagctcggcgatcacctcgatcggggtaaccgtattttgcgctaggatcgcctttaagctattaacggcggtagtctcatcttctataataactgctttcatgagtgaatgggtttattaagtaaaggaagcgtgaccttgaaatattccttgcggttggagatctggatgtcctttccggtaagcatccggtagcgcccccataggttcttcaatccgataccgctacctttgctatcttccgacttaggatgtattttattggatatgattagtttgtcctcatgggtggtatagatatcgatctgtagcgggtattgcttgctgataacgttgtgctttacggcgttctcgatcaaggggagtacgctcaatatcggcagataccaaagtaagtaaggggtatccgcttggatggagaagaatagttttccctcgtagcgcacgctcagcagataggtatacgcctttacgaattgaagttcttccgctagcgtaaccagctctttcttgttgctttgcaagatataccggaagacgttggatagctcatccagataagccaacgtctgttgtttttctccgctctgtatcaaggcgttcaatccatttaaggagttgaagaagaaatgtgggttgatttgtcccatcaaggcgttataggaattctgtaacttctcggtcttcaattgttcatattccagtttcatttgttgcttgctgcttaacaggcggattagtacggaacttagcataaccgtaaggaagacgaaaagatgctccgtcatgaaagagttagggaccgtgaaaggcttgggaggtaccggtatgccccggcgttcggcagacctgatggtttgcgtagccatcctgccccggtcgatgcggatcatgatatcctgggtagctggctggggcccatcttccccaagccattctacgaaaatggccgtgtacaaaaccggcgatagatgaaacatgccgtaggcgatgctgatacaagttacgcaaaccagcaatacccttttatactctttcctgcggaaaagcttgtccccgagcttatacatcaagctgttgacaataaataagatgaaggagaacacgaagaaccagattagcaaataatacatggtgcgatccggaggctggatacccatgctcgggtttccggtctcgaactcatatttacgcatcagaagggcgaagttcacgaaaatactaagcaagacggatatcgtgaagccgatcaataagtcgtttctttttaattgtaacatagataaaccctttgtctgcttacaaagatagggcttccttatccgagcgggaaaaggaatcgacgaaacggataaaaatatcggtgaatcgcccgggcttccgaaaataatgtacctttgccggaaattaggatctctgtcgctatgacgaaatggtttgtctacatatttctggccagtgtctgcctgttgctttcctgtggcggtaaatccgtccgggaaaaatttgcggaggcggaccggttggtaaacgagaataacttagatagcgctgcctggctgctggaggaacaaataacgctttccgctctttcggatagcgataaggcagagtatggacggaggctcgcttggcttcatctcttgcaggggcgcagcttagtgaacgactcgctcatcgactactcagtggattattataaggagcatgcctcggagcctttactttccgcttatttcgtaaaggctatttatatgggtgattcccggaaggggttggaacaaagacgtgctttgtaccgagaggcgatagattccgcttattcccgttcggattcgacctaccttgtacgtttttatgaccgattgacttccttgagctttggtgaggggttgtatcgggaaacgatcgcagactcgaaggaatgggaagcctcgccaaaagctggatttaaggagatggcctattatatggccgggttgagttatagccgcttgcgaatgagggactcggcggattattatcttcgtttggccgcggactcggccttggctaagaatatcgaatggtatgcccatcattttgcccgtaattatgcggatttcttgtatgattttaatcccaaggcttctatcagctatttacgtttgttggaagaacgatatccggagcgagagaccccgggatcctatgttatgccttggatcaatctaggggaattggattctgcccggaagtatatcgagaagaatacattaggcttggaacttagtcacagtgatgatatagcctcgcatgcgctgaattatgcctatcaatttatattgggcgtaaaggaaaataaaccggtggatatttcccgattagggcaatattgcgattctttgtataccgtgaaatcccaaacggagaaggctgagcgggaacgattggtcgatcaaaatcgtttacgccgagaaaatcttcgcttggagatgagccggcagcgtacgttctctatcttggtgatcgtttctttgctttccatattggtagctggtggagttttcttatatatccgtaaccgaaggaaccgtttgattgatatggaggagcgtttggaagccttgcgtcagctcttgaatgagtccaagcaatccgtagcggaggaggagaaacccgatagtgcctttttccgtaaggtcttgttgcagcaattgggtgttatccgcttgatggcgactactcccacgcaacaaaataaggaattgctccagcaaatgactcgtatcacgaatgaggatgtcccggtagatacgcttttggtatgggatgacctgtatccgattatcgatgcggtctatgataatttccatacgcatctggtccgattgtctgatgggcgtttgctggaaaaagaaatccagctttgttgcttgctatgcgccggcttctctaccaaggaaatcagtgtagtcacccaacaaagcgtccgtacgatctatcagcgcaagacggacatccgccataagctgggtatggacgagaaagaggatatcatcggcaatataagtgctcaaacggcaaatataaacttttctctctaagtcgtttgctaatactttgtaaatcagtgtatatgcataatgccttgcactttagtttcttgcctgtataaatcgattttagctgtttccctccttacatttgtctcgaatcaaatttgaattttatgagaagacaagtattatttgtgggattgatttgcgttgcctttttggtaaacgcacaagaggagaaaacgatcgatttggatgaggttaccattcaagcctcttcgattataaggaagaaagaccgtcaacttatattcccctctaaagaccaagtgcagcgctcgatggatggcttggatttgacaaggcggatgtccttacctcgtctatgggtagatccgaatacgaaaagtatctctatggcgaatggaaacgttcagttgcgtataaatggcgtgttggcttcttccttagaagtcgcagccctctcgccggaggatatcaaacgggtggaatatcacgataaccccggcttgcgatatggggaaggaatcgatatcgtcttggattatataacgatcaagcggacttccggaggaaatctcggcgtggatttaagccatcaattaaacacgttttggatggcagattatatatatggtaagtataaccgaggacgttcggagttctctttatccagctttgcgaacggacaccggtataaagaggcatggcaagaccggaaggaaatctttcataccccagatggtaccttccagcgaacacaggaaggaatccccgggagggattatgagatgtattggactacgacggcgaattataactacacgaaggatgatgattatttcttgaacgctaagctgaatttttattattatgactatccgcataactatagcagtgcccttttaaggaatagcgagagcaagatgacgaccgatcttatcgataataataaatccttgaatacccgtccctcgctcgacttgtattatttccggaaattaccacgtaaacaatcattggctgtcaatgtcgtgggaacttattcgaataccgatagccgtcatacctaccgggaagaactggaaagtattcctttgacagatatttatacgaaagtagatggaaagcgctattcggtaatcggagagggtatctacgagaaagagctagagaccggtcgcatttccgccggtttgaaacatacgcaggcttatacggacaacgtatattccggttccggtgattatacgacccatatgacggaatctgaatcgtatatgtatgcgcaatacgtaggaacttggaagaagttggtttataacgtaggtttgggcgcctcccgtaattatctatcgcaagaaaactcgggctcttataatcggtggtatttccgcccgcaggtaacacttacttatactatcaatgaggtattatccgctcgttatcggtataccctgcgcaatgtaaacccatccttgtctgagttgagtaatgtggagcaatggattgattccttacaggttcgtagaggtaatccgggtctatcccctttcttatatcataacaacgccgtggaatttcatgtgaatacggcaaaggtcaaggccggctttactttctcttaccaataccagccccgcatagtcatggaagagaccctgtatgacgctagccggggactttttatccgtacctacgataaccaacggagtttccatcgttttacgccggaactgtatttgaattattcacccttcggcgattatctgcgcatgaatatctccggaggcttgaaccatttccaatcgaatgggaatagctactcgcatacatacacggatcccttctatgtgatctctttgaatagcgatgtgaagaactttaattttaacctgttgatttataagagaagctatagtttttcgggtgagaccagtcgtgaggccgatcgttttaatagattgggtatcggttataggatcgggaaggttcagttaagcgcttctttctctacccaatttacatcatccgcctgttaccggagtaagaacctttcagcgatcgctccctatgtgaccgatcagcgttttggtgatatttatccgggcttcgagatcggattctcttaccacttagatttcggtcgcaaatacaaatccgtggatcgtaagttgtataattcggataatgagtcgggcatattggatagccgaaagtaagttacgtcttatactcgtgttctcgtataaactcatcggcgatgtaaaggttgctgaaaaggtagagcccggtctttttgtcatgcaggtcggcacaagtctggctctcataaaataatcgcagagctcttgccgttgcgatatccaatcgtttggcaagctctgcggctatactgccgattgggtaacgtacgtaaaaagcggttcatgctataaaatccgtggatgaaattatctatacatggaattccgtagaggcagtacttactttaccgatgaagtatatctcctgtggcgcttgaagtatatctcctatagggaagggagtggtatctcgtgaaaatgacttttcgagaaacgttccaagggacgtgaaaagtgactggaaaactacttagtaagtaggccgacctttacttattaagtagacaccccctttacttagtaagtagatgtcgctctacttagggagttgttggctaaatattcgcatggatgtttgcgggattcatgggaaattccgtactttgtaccgagccgttagagtggaaactctgcgggttcgttttcgtggaaaaggcgttaaaagatattatacctatatcagaaatccccaatttcatatcccggtataatacaacagacgcccatgcttgttatagttacttcgagaggagcatcctataatgaagcgtggggctgctgttcgttaccgggataaaggtatggggataccatgatataggtgacgatggcataagcctcgcgctttttctttgtgtggttgataaggaggagttgatggttgcagggtaaatcaattattaattcaaatagaatgagtatgaaaaaacttttctttctttttgcttttctcgtaggacttgggataagtagtagtgtgtatgcgcaattggtgcaggaggtaacactggattcgcctaatacgctggcatccaaattgggtgtggatgtgggtaaggtaacgatattgaaggtaagtggcccactgggagcggaggactttaagacgatgaaggagcaaatgaatatgctccaagtgttggacatgagtggagtgacggagttaccgaaggcgggtggcgcttgggcagatttacgctacattcctgccaattctttccaaaacaagttgacgcttcaaaaggtagtatttccgggagtgcttcaaatgatagagagggaagcttttagcggttgtaataactttacggaagctgatttctcgaaagccactcaattgcgatcaataggatatagcgtgttttatgaatgttccggcttgcgggatcttgatttatcggcttgtacgagtttagttggaatagggagtaatgccttttatcgttgtagtaatttacaaacggttaatttatcgggttgcggaaagttgacgagtatagaatcctatgcgtttcaaaattgttcctctttgcggacagtggacttgtctaattgtacggcattggcaactttgggatccgctgcgtttagctcttgttcgaatttgacgagcgttggtttggagggatgtacggcattgactacgattgagaatagtgccttttatcattgttataaattatccgatttcgatttctcacaattgacagccttaaaagaaataggcaaaagtgcttttctttattctgccttggccggtgacattgtttttgcttcaggtatccagcaaataggagagagcgcattttatggcaatgatgctataaccagtatcgatttcagtaaaagtacacagcttgcggttatttcttctggaacgtttagttttagtcaaagcttgaaaaaaatagactttagtgattgtacatccttgaatacgttgaatatagaagcttttctcgagtgcccttctttggaggaagtcgtaatcaataacggcttctatacctctattgatggtgttctttttgtagttgataaagcgactttattgctctatccaaaagggaagaaagcggaggcttatacgattccttctacggtgaagacgcttggtgagcgttcgtttccttataacgaatcattgatggaactgacgatcccggaatctgtgttgactataaaaggagaggctttttataacggatctttctcgggaagaggagcgaaagtaatcatgaaggctgagaagccgatcggcttgtcgcaatcgatcggtttggagaatgcgttggtatatgtaccgaaaggctttgctaaggcttatcgtgaggctgctttttggaaagaaagcaagattgtagagatcgatgcggatcctgtagtagtgaccttggatgcggccggttcgctgggtgcgaaattgacggaactgaatattccattggctactatcttagatttgcgtatcatcggtccgatgaacgctagtgacttcgaggtcattaagtaaatagagctgttgcaaaaggctgatttgagcaaggctacgatggaagaggatcgattaccgaattatgcgtttggagggttgcgttatttggaagatgttattcttccgaatacgataaaggagataggtaattctgcgttctctggtttatccgcattgcggaaagtgaatatgcccgagtttgtagaaaggatcggggagtctgcgttctcggactgttccagcttacaaaagattgatttatcgttattgtctcacttgaaggcggtcggttactctactttctcttccagctcatgcgtgcccgtttcattgaaacttccggatggattggagcggattgacggttacgcttttaataatactggtgttacttccgtggacttcttgaatacgtccttgtcttatataggcaacaatgcattctatgcatgtccgatcaccggcacattatctttccccggtaccttacgatccataggcaattccgctttcgcttccgcaaaggtctcatctatcaagttgaagtctacagagatggtacgtttggatggagctgatgtttttaaatccgtagataagaccacctgtaaagtttacgtcccgaaaggcatgaaggatacttataaagcaaacacctactggtctccattcggaaataacattgtggagtttgggcagttgattacggcaacttctaataatgaaaattatggatgggtagaaggtagcggtgcctatgaagagggggaaatagtgaccttgaaggcggtttgtaagggtggaaattgggaggattattattgggctaaatatgttaatttgttctttggctggtatgatggtgagacaaaagtctccgatgatactatatatacttataaggcaggtaaggaggacaaagcatttgtcggtaaattcgtgcgtataagtttccctaatacatcagaccttcttcaaatggtaagaaatgatagtaaatccattacggtgagggtggagatgcctgccgatgatcctcgattgtttgctggttggtatgagaatgatcaatgtgtttccaaggaagaagagttgacggtgcaagttggtatggtagaccgatccttggaggctcgtttcttcgacgatggacttatggttgttaacggtggtaatgtcatcgtaaatgatcagaataaggtggatggacctgctgtaattttgcatcacggtagcctcaccgttgagggtaatgagatttggaaaccgaagagctttgcttactatcgggatgcctccttgctggtggatgctgagatacagaccgaggcgatctccttcaattggaacgctaggagtaactattggcatttcgtatccttcccctacgacttgaagatgtccgagatcaagctgacaagcagcgacgctcgctttgtcgtacgggaatacgatggcaagtctcgtgccgataagggagtgggtgagtcttggcgacagctttgcgactcggagaccttgaaggcaaataagggatatattatccaattcaatagcgacgatacgatggccgatggatttactacccagaccggtgatatgaaagccctccttaatcgggcgagcgtggcgattccgttgaatacctacgcctcggataatgccatgaatgccaattggaacttcgtggggaatccgtatcctgcctattatagcgtggagcgattgttcgctgatggattggacgctacggtgacggtttggtctcgcaatttgaataattacgagtattatacgcaggatgataagggtgtttatctggcaccgcttacggccttcttcgtacaaaagaagacttccagcttggtattcaatccggagggtcgtgtggccgccctgccgagggaaacgcaagcagcttcagcgttacgtagtgtggataaccgtcaagttgtcaacctgctgttggcaggcgagaaggcaagcgaccgtacccgtgtggtattcaacgaggctgcctcgctggagtatgagatcggtcttgatgctgccaagttcggcagtccgaatgcggaggccgcctctttctatagcttggatacgcaagggaatcgattggctatcaacgagcgtccggtagcggatggcgtggtacgccttggatgtgtcctgcctgctaagggaagctatacgatctcattgaaagagaagattggcaaaggtattcagttggtggataagcagacgggtgccgtatgcgacctgaaccaagaggcttataccttcgaggccgaggctggaaccctctctgaccgctttgagctgagaagcgatgtggtgacttctgttgaggcaatcgatgcgtcgattcgctggaacgtgcgagaaggcttgttgatcgtgtccggcttgcgtgatgtggaaactttgagtgtatgcgatgcggcgggtcgtattcatttcgctggtaaagtgacggatggtgaggtacgtatggccctacctcagtctggtatttattacatgacatggacgacaaaagcgggcgagcgtcagacttgttccattaaatggtaatcgctatgagaaaacgattgtttcgatatattacgatggctttgtctctttggatcttcctcggaggatccatcgggcaagtctatgcgcaggatgagttcaatccgactcctccaccggagccggggaaactaacgctcttactctccacggatccccacggatccgcttatttggagcaaacgaatccctccggcatttatgatacgggtacggaagtaacggtacgggcctatccgcatacggattatgagtttgtggcttggcagtccgctgatggagaagaattgtccggcctctcggaatataccttcacccttacggagaaaaacgctcgcttgattgccaagctacgttttaacccgaaggagaatccatcggagccgggagatggttattataatctgattacgaccgtcgctccttccatggccggatgggtagaacagagtggccaaggtatttatgagaatggcaaagaggtgacacttatcgcccatgcttatcccgattatgtgttcgaccattgggagagcgatgggaagaatgtatcggaagagacaacctatcgcttcaccatgccgggcaagcatgtgtacctgcgggccgtgtacgactggaagccgcaaagtcctatcgagccggagatcgggtattgcctttacgtaaacacttccgatccggaggccggctatgtatcgcaaagcggaaacggtatctatgagttaggggatgaggtgaccgtgatcgcctcgcctacgaaagactatgactttatcggctggtatgatgaggcgggtatgtgcctgtctaccgacatctcttatacgttgactattagtaagcgaaccactacgatcgaggcttgtttcaagaagagagaggcaccggtggatgaggtggagatcgtacccgggccgaatccggatgatccttcatctacggagaaaggcggcgaggtggaagtgataggcgaagccattcccggccaaacggtcgagatcatcgcgatgccgaaaccgggttatgcttttgaaggttggtatttggatggcgtgtttatcccggaggcggagatgagccatgagatcttgatcggtaaagatatgggtaagctagaggctaaatttcgggaattacccgttgacttggaagtagagggtggagagaacggttgggcggaagtgactcgctatagaggtgatgtcattaacttgaaggccgagccgatcgtagaccatacctttatgggatggtacttgctagatcagttattgtcgaaagcgttgaattatgattttgatgtcaatattctacgtgcggccttgcccgctattcgtgcggtgtataccaaaggtacggtagccaatgagacgatcgttagggaggaactagtcacgatcgctttctccgggaaccaactctgcgtgactgctcgccaagcgatccgtagattgatggtttattcgttcgagggggacttattaggtactaacggccaaatggaacaaggtgatatctatcgcttatccatacgtagccccttacttctcgttatcgaggcaacggatggtactcgtatcgtctgtaaattgtcctccggacggtagtccgtggcgcgacttggatatatgatttctttcaatgcccattctaaggttcttataatgcccatcgtaagctcctttgaatgggcattgttagatgcttacgatgggcattgtaagaaacgataaacaaaaagccatccggcattccgctggatggcttttcgtatggcaatagaatcggagagattacactctcttttctttgattcttgctttcttaccggtaagggcacgcaagtagtacaatttagcacgacgtactttaccgactttgttaaccgtgatgctttcgataaacggagattcgatcgggaaaattctctctacacctacgttctcagacatcttacgaactgtgaaacgttttttgtcgccgtgaccggagatacggataacaacaccgcgatactgctggatacgctctttgttaccctctttgatacggtaagctaccgtgatcgtgtcaccactcttgaatgaaggaagttccttcttcgtagcgaacgcttcttctgcaatcttaattaaatccattgtttatagctttttaattgtaatttataatgaaacgcaatttaacgggctacatttcccgacagagattacgtaaagcgggtgcaaagtaacgaaataaatatttgattcgcaatagatagatgcttttttgctcgctatttgattaaatcttttatgtctaccaaggattcaaaccattgacatccaccagcgattcccgttcctccttccacattgctgtagatccggacaggctcggccagacctacattcgtaagtccgcccatgataccttcattctcgatgttttgtaaagatagcagatattggtaatagggttcggacagggaatataaacgaatatggcgtttggtataatatttagtatcggacctaagttgttcttttacttgcaacgtgtattccttcccgtcgaacagctcgtcggaaaatacccgtccccgccaatttaccatcgaagagccgaaaacctcatccaagataccttgttgttgcgtgaatacgggatctacggagaagtccaacaggacaccaagatggtcgtcatctccccatatctgtaaagaatagtaatttgatttacccggggtatcttggaaagtgatttgatagataagcacatcgttttcttctatgtaggagatattcccatctccatcaacaagggtaccgccgttgccggtagcttctttacggggaattatgcgcaggcctttgatttcggtcttggaaggaatcttatcttccgccgaggctgttccatattccggggtagaagctactatctttacggtttgtccgggctgtggaaccgtattcgatatataaagcgtatctgttacccatccacctcgatcctctccgagccaacgagaagatttccaataggaatattctttccaaggcatctcctccttgaagatcccgtctatatataattccaccttggcgtttcgaatcgtcacgtccggcttgctctctgagtgaaaccatgtgcgggatatgctggccattacgactgtatccggcgagaaggccgagttgatcaccatttttggtgtagtacgatattcctctaggtcaaacattctgtaacaggaggttaggagcaggctggataataagattgataaatagaatataggtttcatgttctttagaatttataagtatatgatatagacggaatgatcggtaagatcgataacgtctcgaaataatggctatagtttatccaagaccgcttatggatagttatcgggttcatctggcaataagcgttatatacgctgatattccagataccgagatggccgttctttttaggtcgataaatattaatccccagatctaagcggtggtaagcggggagacgtacgttattacgctccgtgaaatagtccaagcctccttccggtaagagcggagggacaggagtgaggcccaaatcctcgtaattctcgaatgccaccgtaacccggtttccggtcatgaaagtccagcttcctgttagttccaatttctcgttgatcttccagttcgcgaggatattcagcttatggcggttatcgtatttcgcggggaaacgtttgccattattaatctcgtcgaactgccggtcgctccacatgagtccgtatccgatccatcctgttatacgccccgtctctttccgggcgataaactccgctccgtaggcccaccccttaccggcggccagtttctcctcccaaccgacgaacgagggtaagaagttgtaaccatctttataatccagtaggtgattcatccatttatgataaccttccaccgagaaggaatagtctttgtgtaaattgtaataagcgccgacggatacttgatcactctccaatggcttcagcttcttgctgaccggcatccacatatcggtagggagactcatataactttcgctgatctgatgtacgtattgattcatccgggcgtatgaggtcttaaggcttagattcctcgtgagcaggaagcgtacggataaacgagggtctaaggagacatatgtcttcttttgtatattatacatgttcaggcgtaatccggcgttagcccggacaatgggagatatcgcccagtcatcttcggcgaaaacagccaactcattcgctgaaaggcgctcgtctccggtagttcgtttggtcggagacaaattctcggaggtcttttcctcgatatattccgggctgaaacgatggtaaagatagtcggtgccataacggatatgatgtgccggggtaggaatatagtcgaagttcgcatggactccgaaatcattgataccgtttcgggttgaggtctcgataaaacgtgaagaataatctttgtcaccctcggttccgtagtattgtgaagtctcttgttttagtttggattgataatgggaataagccaaggtgacggtaccgaacatcttgttgttaaacacatacgaccagccggaagataatgcgatgttaccccagcgcatctttccaaagtccttgttctcgaaaggagttatatcatcacctacggagaactcagaacttcctccttttaggaaatcctgtccgaaatagaaattaacgtaagcttggctccggtcattgatatggtggttcacttttaggttcagatcggtaaaagcatagcgtgcgctgaatttctcccccttctttttctgaattttattgtagatcgccaaacccggtgcggacaaggcatccagccaagagcgacggaaggaggcgttgaacgaagtccggtctttaatgatcggcccttcgaaatttaagttaccggaggtcaatcccagcatggcgctaccatggtactctttcatattgccatctttagtatgcacatccactacgctggaaagccttcccccatagcgggcggggaaagcggatttataaaaatccacatctttcaaagcctcggcgttgaaagcggagaaaagccctccgagatgattgacctgatacagttggattccgtctatcatatacaggttctcgtctccattccccccacggacatacatcccggctaatccttccgttccggctgatacgccgggttgggtttgcagggctttgatcacatcggcctcaccgaataaggtcgggatggtcttgatcatcttccgggttattttaatcgttcccatctgaggggcttgcatcgggttttgtgtgtcattactaccggtaacgacaacttcggccaatgcttcaccgctttccagcagaatttccatcacggtatcccgttcgagcggttggaatgtatgtgagaaacgtccgtatccgatgtaggaagtctccagacggactaccccgaccggtaaggttagactgaagaaaccgtggttattggtagccgtgcccctttgtgtgcgggagtcataaacggaggccccgattagatactccgtagtcgctttatcccgtacgaatccgctgatggttactgagcgggggcgtttcttcaagatgatgtgggtaccgtttatctgataagacagagggagcttttggaatagccgggtaaggcattccgatatggattggttatcagatttgaatgtaatccgggaaatgcctttgagaatagaaggatcgtaggagaatgtcatgcctgtttgatgctctatttttttcatgatttcttggatcggctcttgtttagcctcgatactgagagtcggcgcttgtccccaagcgcttgattgaaagccgaagataatcaagattatgagtagtattagcttcatgaagtacttcattttttattacgagacaggaaagatagtaaaaacccctatcacaattcacgttactattgcgatattttcttatttttggagagtaataatgataatgttgtgatgagacagattggtatcttgcttttgtgttgtatttcccttttatcgagtggggcgcaaacagtcccgaacctttatcgtgaggtggatcaggaaaagatgaatcattgggttgattccgtgtttgacgctatgagttatgatgaacggatcgggcagttgtttatggttatagcgaaccctaaattcgataaccggaatatgcaacggctcatgcgttacgtgaacgatatcaagatcgggggcatcttattccataaaggggatccggtgacgcaggcggaggtaaccaatcgtttgcaaaaggcttcccggattccgatgttggtctctttggatggggagtggggactttccatgcgattaagcggaaccacccgtttcccgaaaaacatgatgctaggcgctatcgaggataatgccttgatcgaggaatatggaaaagaggtgggacggcagtgccgggaaatgggaattcatataaatttcgctccggatatggacgtgaatagcaatgtggataatcccgtgatcggcctgcgttcgtttggcgagaatccggaggctgtgtcggagaaaggtattgcttacgcaagaggattggaaagtacgggcatcttgtctgtctccaaacatttccccggacatggagatacttctgaggactcgcacgagacattacccgtcgtgcgccataaccgggcccgcttggatagcgtggaacttcttccttttaaacgttatatatatgatgggttcgccgggataatgacgggacatctttatgttccggcattggacaaaagtcataagccggcttctttctctaaggcggtagtgacggatctattacagaaagaactcggttttcaaggtctgtgctttacggatgctttagcgatgaaaggggcttccacaaagaaaacggataatccttcggtgaaggctttgcttgcggggaatgatatcttgctcgctccggtcgctccaatcaatgattttacggccgtgaaagaggctatcgaggaaggggtattggatctggaagcgatcgaggccaagtgcttgaaaatattaaggtacaaatatatcgctggattgaatgcctataagccggtcgaaacaaaaggcttatcgaaacgtttgaactctccgcatgcggcatggatggcggcgaaattgaattcggaggctattaccgttttgaagaatgaggatacgatcttacctcttaaacagttgaataagaaaaagatcgcggcgctctcgattggagacggggttggtaatgaattccagaaaatgctgggtgaatatgattcgatcgcttgctttagcattggacggcgttctacggctgcccaagtccagcaggtttataataaattgcaaaaatacgacgtgatcatttgtggcgtacatacgattcgcattcccgagagtttagcgttgaggcagttggccgcgaggaaagagttggtctatgctttctttaccttaccatatgcttgtaaggaatataagaagtcgatcgagaaggcgaaggcggtcgtgttggcttacgagggcactcccttagcgcaggaatatgcggcccaagtgatattcggtggtattgcggcgaaagggaaacttccggtttcgattccgggattgtattatgcgggtactggtatttttacggaaaagactcgtttggggtatcaccagccggaagaggtgggagcgaatccggaccgtctggatgtaattgagtcgatcgttaaagagggattggatgagaaggcttatcctggatgccaagtgttggtggcgaaggacggcgtgattatctataataaatcgttcggttattttgattacgaaagtaggcagccggtcacggagtcatcggtctatgacttggcctcggcgtcaaaggcggcgggaactttattggcggtcatgaaagcgtatgatgagaagaaattcaccttgaacaataagatctccgattttataccggagttgaaggagtctaataaaaaggatttatcgataaaagagttactgtaccatcaatcgggagtgactccaactattaatttctatctggatgccattgataaagatagttataaaggcagtttatatagttcggcgaagaacgctacgcatccggttcgttttgacgctaaaacgtatgtccggaatgattttaaatatcttccagatgtagtttcggatatccggaaacccggatttacgactgaggtagcccgtaatttctatgtgagtgattcctttaaagatacgatccttcaagatatcaagaaatcccgtttgggtacgagaggtaggtacgtatatagttgcgtgaatttcattatgctgaaaatgatggtggaaaatctgatgaaatctccgatggaccagcttcttcgggatgatttctacagcgggttaggggcttggcacaccacttataatccgttgaagcgaatggataccttgcaaattgtacctacggagcaagatggatttgtccgccgtcaattgcttcgcggatatgtgcatgatgaggcggccgcttttcaagggggtgtttctggaaacgccggattattttcgagcgcgaatgatctggcgaaggtgctccaattgatgctaaaccaagggacttatggcggcgagcgctatctttctttggaaaccagccgtttgtttacacaaagcaagagcccgacttgccgtagagggctaggatttgataagccggtgattggtaatccgaaagcctcgccttgtggggctttggctcccgcctcggtctatggacatacaggatttacgggtacttgtttttggatagatccggataaccagcttatttatatatttttgagtaaccgggtgaatcctagccgggcaaataataaactgggatcgcttgatatacgtactcgcatacaggatgcgatctataaggcgattgataggaaaagccaaaaagattcgtaattttgtgacagttttaacagataaggtattaattaaaaagcaggtatatgttatacggacacggtgatgatttttataacgcaaagaacgaggtaaagataaactttagctcgaatgtgtggcacggagctaatttagataaactgaaggaacatttgatcgagcattttgataagctgactcgttatccggagccggatgccgctaccttgaaaagattgttggcccgccggtatgagatcaaggaggagaatatcgtagtgacgaatggttcgatcaccgctttttatttgttagcgcaagcttggcgaggtgcgaaatccatgatcgctattccttctttctctgaatatgaggacgcttgccgtttgcatgagcatgagatctctttcttcccgacatcggacgatttatcagagttatccttggagggacaggatttctgttggatttgtaatccgaataatccggatggaaagctgatccatcgtacggagcttctccgtttgatctcagcgaatccgcagactaccttcattattgatcaggcatacgtggcttttacgacggaagacatgctaaagccgagtgacttgaaaacgcataagaacttaatccttgtccagtctatctcgaaggcttataatatccccggcttgcgtatcggttatctggttgcttctccggagatcgcggagaaagtgaacatgtatatcataccttggtcggtaaatgctatcgctatcgaggcaagtaaatatatcttgatccatccggcgcaatttacgttgccgatccgtaaatggcagcgtgagaccgcggattttatttatcaattaagtaaattggatggcttggaggtaatcccgacctctacgactttcttccttgtccgtttgaagaagggtacagccgctgatttaaagcaattccttttagataattacggaatcttgatccgtgacgcttcgaatttccggggcttggatgagacttatctacggctctctacccagaaagctgatgagaaccagcttttacttgagggggtaaagatttggttggaccaacgataaacgactatgaaggggaggggggaaccccttcctgttaaaaaagccagccgataaatagaggtaggtaatcttttagctctgtctttagaagttctgttgccttgttcttgtatctttccacggttcgtatggatatttgcatttcctctgcgatttctccatagctcttattctcgaaacgattcttctcgaatgcgagccgatagttctccggtagcttgtcaagggcttgtcttaataacgtttgcagttcttcccatgtgtagagttcctcactactttccgcatagatcgggatttgttcttggatgagcgattcgtaatatctttcatggttgcgttgcagataatttaagcagtgatttctggcgcaagtgacgagatagctacgtgcggaggtctttactgagatacggctgcgattttcccaaatagcgaaaaacacgtcctgcacgatatcttctcttgtttccttatctgtgataaagcgtttggcgtacatacaaagtgccggataatataactcgaataagcggtggaaggcgagcctattatcttcagtcgtaatttgttctaaaagtaaatcgacattaatagccttggtatgatttctttccatgatggggcaaaggtatatattttttgaagagaacaaaattaaaaaaactcattttcgctgtcgtgtttttctttagagtgtgtctctataagtaaaggaagaaaatatatggaaagaaaggtagaacataaaagtgtgtcacgtcaggtagaggaaattaaagccttgtctgaggacatattagagtatcgatcgattgacgtgcaaaaggcatggctacgaatggaacgtcgggtagggcggcaagctgtcagacgaactttgtcgctgctttttactcgtgcggcagttatattggtgcttccgttgttattttcttcgttacttttctcctatttgtattatgccacaagatatgacgagaagtcccagcctgtcgtttatgctgaggttaactccctgcccggaacgattactcggtttgtgttgccagaccagtctgtcgtatggttgaactcgggtagtaaattgacctatccgtcggtgttcgaggagaaagagcgcaaggtgttactttccggcgaaggatatttcgaggtggaggccgatccggaacatcccttttgtgtatcaacttccgaaggtttacgggtggtggcctatggaacaaaatttaatgtcaatgcctatgctgacgaaccttttatagaggccgtgttggaaaaaggaaagattgacgtgatccggaatgatgaacgtatccgattggagccgaacaaacaggcggtattggataaggagagcggtactttcagtgtttctgcggccaacctggaggagaaaatggattggaaaggaggacggatagttttccggaatacttctttggataaggtgttgaaacgattggagaaacgatataacgtggagatcgtattgcataagagcgggaatgcggagtataaatatcgggcgacctttactacggagactttggaacagatcttggattatttgaaacagactgctcctatcgaatggacatcacgagagccttcgcaacgtctggattcctcgtttgttcgccggaggatcgatgtttatcaaagataattggaaatctatactaatatattgtgtaatcattaaatctgtatgctcatgagcacatttcatttacgtaagagaaatcttgcgcggtgtttacctaattcgggccgtatactgaaacttagtacggcatttacatttttgacagctttccagctatatgcgggaacatcttcttcgcaaggaatgacactttccttgtcgttgaagaacgcaacggtagaacaagcgattgatcggatcgaacaggagactggttattctttcttgtattccaatcatgtcctagacacgaaccgtcttatcagtttgaatgctagcaataaggatataagtgtggtcttgtcacaggttttcgacaatatgggggtcgaatacaagattgtggataggcaaatcattttgtcgcgtaaggtggagtccgctcctgtcgtacagcaacaaggccgtaaggtacagggtgtcgtattggatccgagtcaagaaccgatcattggtgcgaatgtcttggtgaaaggaacctctattggtacaatcacggatattgatggtcgtttcacgttggaagtacctgataatgcggtactggtcgtttcttatatcggttatttgtctatggagctgactccgggctcgaagacggatctgacgatatctttgaaagaggattcgcaaaacttggacgaggttgtagtggtaggttatggcgtttctcgtaaaaaggacttgacgggtgcggtttcggtcttgaagatcgatgacttgaaagatacaccggtatccagcgtagaccaaatgatgcaaggtaagttatctggcgtgaacgtgatgccggataatatgccgggtggtggtgtcgctgtccgtatccgtggttatagtacgattcgtaacaatgaccctctttatatcattgacggtattcccgtggatgggggaatcaatttcttgaatccgaatgatatagagtccatgcaagtattgaaagatgcttcctctgcttctatttatggagcgcgtgccgccaatggtgttgttatcattaatacgaaaaagggaaaagaaggacaattcaatgtgaatttagatgcgtacttcggtgtacaaaaagcggctaaacaattgaagatgttgaatgcgcagcaatttggcgatatgttgtggcaagcgatgaaaaacgacggaaagacaccttcacacgatgtttatggaaacggtgatcaagcggttgtgcccgaatatctggataaagatcataaaattccttctgatgacgtggattgggtagatgagattttgcgtgccgctatcgttcaatcctataacctttccttcacgaaagccgataagaaatccaatcaattgttttctttggggtattatgatcagcagggattggtgaagttaagcgatttcaagcgtgtgagcggtcgctttaattccgagtataaattgttcgatgaccatcttcgtatcggggagaatatttctctttctcattcttggggtactagtgtctccaataatgcggcgttgggaggaactttgtatgaggcctataagttccagtcgatcacaccggtgaagaacttggaggatgaatatgcgggaaatgtcttttcggatattcctaacccgatgggaaagttgcatagaaataaggataacaaggataagaagagccgcttggtgggtaatttgtacgcagagctgcacttgtttgacggatttatgttcaagacttcttttggtgcagactataataatctatacagacgttcttttagccctaaatatgatgagatcaacgcttctgagaaattaagtggtttgtctaaccggaatgcatggaacttcaactgggtgttcacgaataccttgaactataccaagacatttggcgatcatacgatcaatgcattgttgggtctggagtcgttgagaaaccggtatgagtattttacggcttcgagagatggtttcccttcggatgatcctaacttccatttcttggatgcgggcgatgtaggaacccaaaagaactcagggtctgccacggagtatagcatggtctcttatttcggcaagatcgattacaattatcacgatcgttatttggtcgctttcactttgcgtcgggatggatcttcccgtttggggaataataagtggggtaacttcccggccgcttcggtgggatggcgtatcagtaatgagccattctttgatgtggaggctatcaataacttgaagcttcgtgtcggttggggacaaaatggtaactctgatgttccttcttacgcaacgatcgattcctataagagtagttcatctacctcgaattatccgattgatggaagtcaaagctctgtggatttaggatttgtgcagactcgtaatggtaacgctaatttgaagtgggagacgaccactcaaaccaatgttggcttggacttaggtttcttaagcggtgacttgaatttgacattggacttctttaataaggacaccaaggatttgttgtggcgtagagccttacctgcttcgatcggaggaacgaacatgacggtttgggataacgtcggaaagatgaataacaagggttttgagatggaggtgaattatcagaaacagatcaatcaagattttggcttctctgtagcatataatttctctatcatcaagaataagatgacagagctgaatggcgtggattatattggtctttccagcagcgaacttcatggacgaaactttgaccaagagacctctcgttcggcggtaggacaaccgatcggctctttcttcgtgtatgaggcagatggcttgtttcaaaacgacgcagagatccaaaactataagaatgataagggcgagctgttgcaaccgaacgctaaacctggcgatattcgctttaaggacttgaacggtgatggagtaatcaatagcgaggatcgtgattttgtaggtagcccgctgcctgattgcagtatgggtctaacgcttgggttcaattataagaactttgatataagtgcgttcttccaaggggtatttggtaacgaggtttataatttgacaaattatttgggtgagttctataatcaagctcagtataataaaaactctacgattctggatgcttggagaccggatcatacgaatacggatataccacgtgtaacattggatgacccgaataataatatccggccttctacttattatattcataacgcttccttcgttcgtttgaagaatttgaagattggttataccttgccggatcggatcgcatctaaattgaaattgaaacgtacctatatttatttacaaggacagaacctgtttacgataacgggctataatggtattgatccggaggtgggtttacagagctattcttccgagaaccgaaatttggatatgggtgttgatcgtggcgtatacccgttgccaaggacattcaccttaggagttaatgttaatttttaattgaaaatctgatgtacgatgaaaaagatagttagtttagttgttgcggctttagtgatgtgctcttgtgccgattcttttctttctgaggagcctgtaggggaatttatgcccgagcaggtagaaagtgaggaaaacatagagggaatcgtgataggtgcttatgcggtattggatggatattatgcttcggatgcgatcaactccggttgttcgaattggcagtttggggatgtcgtatctgacgatgcctataaagggggtggaggtaccggtgaccaaaaccagattcacttgatggaaatctttaatgccaatccgacgggtatcgattttgaggctcgttgggctgctctttatgagggtgtaaagcgttgtaatcaagcgattcgtttgttgagcaatagtacggtaaagaacaaagagcaacgtttggcggaaatgcgtttcttgagaggacactattatttcaacttgaaagtcatctataatttgatcccttggattgatgagacggtggttgatccgaatgagtatcatacgaaatcgaatatggagtttacgtccgaccagctatgggaaaagattttgggggaattctctgccgcttatcaagtcttgccagaaagccaatcagattatggacgtcctaccaaaatggcggcaaaagcttatatggctaaggtgtatttatatcagtcgaaatggaaagagtgcctaagtgcttgtgatgaggtgatccagtccgggaaatatacgctgtatcctgatttcagggaagtgttcttgccggagaatgataacaactcagaaattatttttgcggttcagttatctattaacgatggagcgtccagtaatcaaaacggaagttatggcgatcgtttgttaccgccgggaggtccttatccaacttatggattcttgcggccgactcagaatttggtaaatgcttataagacgaatgaaaacggcttgccttataatgatggtaaggatgtagcggaaagcgactatgtggatgttcgtttggatcataccttggctcggccaaatattccgtttatggatgtacaggtgtatgattggactccaagagaggctagcgtatatggcccgtatagtccgaagaaacgtttggtatcgttgaactctacccattactctccaatatggccatatgtgaatgcgttgaatttttacgtgattcgttatgcggatttgctgttgtggagagctgaggccgctatcgagaccggtgatttggagactggacgtaagtatattaataaaattagggagcgtgcaaagaatacacagcatgtcaagctgtgggatgatcagtcgcaagatgccgctaattataaggtggagatttataccgagccatttaagtcgaaaaatgaggctgtgcaagcattgcgtatggaaagacgtttagagatggctcatgagggtatccgcttctttgatttagtgcgttggggtattgcggatgaggttctcaatgtgtattttgagaaagaaaaaacattccgttcccacttgcagaatgctcgctttgtaaaaggaaagcatgagtattttcctatacctcaatctgttatagatatttgtggtgctgaggtaatgaaacagaatccgggttattaaagttttatgaatggttgaaagaaaaggcagtgcccgtttggggctgccttttttattatttttgtatagagatgaaacaattgagatttcttttatatctgttgagttgggttgtttgctgtgagctatctgcgactccccataatatcgcttctttggcgaaagtctcttgctcttctgcgttaacgcaggaacaaggttgtgagaatgtagtggatcaggtgattcgtattgcaggaaaaggagagtgggtcgctaaaacaaagttggacttccgggggcgggtgtatccctatccttggattcaattggattgggaagagcccatttatacgaatcaagtcatattatatgatcgggtagataaggacagccatacggcggccggtacgttgttctttagcgatggaagctcaatcacggtcaaccagattcctaatgatggagcaccgaaagtggtgacgtttgagactaaaaaaatagaatggcttcgttttcaggcgacagatggggaaggacgagatttaggtttgtctgagatagaggtttatcccgcaccggaatcttatacagattatgtctcatgggttaatccgtatatcgagacggctaaggggcggtattttttctttgttacaggaagcttgccttttggaatgatcagttccgctccgttaacccgtaatatcaatcagggaggaggaggttataattataactctacaacggtattaggttttccgcaaattcataattggatgatttctggcttgtctctgatgccagtaaaagacgaggtagatgtctgtgggggggataaggcttggcgttcttctttctcccatgagggtgagatcgttcaacccggctatcatcgtttatttttggattcctacaagatatgggtggaacagaccgttacggatcgagtggggctttatcgtcttacgtatgcggaagatggtttggcgaaggtcttggtgaacttgggaggtcatatcgctacttctactttgttgaatgctcatgtgactaaagtgagtgatacggagatctccggatattttgatacagccggtcgtgtatggggcggtgtggatgttgcgaaagtgtattttgtcgttcaattcaataagccaatcgaggcattgaatggttgggtgggcgataagaaggaaatgggagttggacattttacgggttcttccgaattaattaccgtgcctaagtcctcttttaaacaatctccttcttctggcgtagaagcttgttttggatcttttaaggctggtgatgagctgttgttgaagaccgctatctcttatgtgagtgaggaaaacgcccgtgagaatatagagcgggaatgtaaacattgggattttgatcaagttaagagtgcgtccgagcgtatttggaatgagtggttgggaaaaattgatgtgcaaggtggttcttttcagcaaaagaccaagttttataccgatttgtggcacatattgttggggcgccataagatagatgatagcaatggcgagtatccggattatttgtccggaggagaacgtattggaaaacaaacaaggatacatacgattgctcctaaattccaagtacggactttgcctaaagataaaacaggaaaatcaaggtttcatatgtataattcagatgctctatggttgacacagtggaatttaaacacgttgtggggactggcgtatccttctgttttagacgagttttccgcttcttttatcgaatatgacaagaatggaggtctattacctcgtgggccgtccatagggtcttatacttatattatgacgggctgtccggctacctccttgattacttccgcttatcagcggggggtgtttcataaatggtcgcccaaggagggatatgcggctatgaaaaggaatcatgagaaaggtggtatgcttgcctttgatatggataaagagttggagttctatattaaacacggatattgcccagaagaggcaggcttgactattcaatgggcctttgaggattgggctttgggagaaatggcgaaagctatgggaaaactcaaggattataattattatagaaatcgttccttgggctggcctgcgtcttggcatccggatttgaggttgatgatgcctagaaaagaaacaggagagtgggtccatttggatcctttgtccgagcgtgggtttgtacaagccaatgcttggcaggctacttttggattatctcatgacattgaaacattggctcgtttgatgggaggtaatgacagcttagctactcaattgaattatgtgtttgagatgtcgaaaaatgcaagattcctgtctagttatgttagttatgccaatcaacccggttgctcgaatgcgcacattttctcacatgtaggaaagccttggctgactcaatattgggtgcgtcaggtcgctaaacagacctatggtgatattacgccagagcgaggctacggcgaaaatgatgaagatcaaggacagatggctggaataagtgcactgatggctatgggattattcagtttggatggaggctctgcctataatccgatgtatgatattacaagccctgttttcaatgagattacgattcgattggattctcggtattataaagggaacgagtttaagattaaagtacatgataactcccctgagaattgttatatccagaaagcttctttgaacggagagatgtatcataaatatcaattgccgcataccgtatttgagcaaggtggccttttggaattatggcttagcgataaaccaaacaaggaatggggaactcaataacgatttgggcatatctctcaatttgcatgatgattcaaaaaaaggatgtgcgaaacaatgaggcacatcctttttcatttccttttaaatctaagtagcgtgtattattctactcgtttgttgattacgatatgaccaaaatagccaaggagaaccaatcccagacctgtaagtagaatactatttgtcataccaccggtaaaaaacggtacagccaaaactgccgcaccaataatgagtacgatcactcctagatttttaattaactcattcatggttatagatattttataattattttcttttctaccgcaaataaagcaataataacccgatcgtgaaaatattttcggagaaaaataatgaaacgattgaaattagcttctatatttgtgttataatatagttacgtatgggaagaatactttacatagtttatttgtggctgttttttgtacctgtatttctggtactgactatacttacggctgtgacggttatcatcggttgtctattggggggagagaaaatcttcgcttattatccgggtatgatctggtctcgattgacttgctatctggcgctttgtccggtgacggtaaaagggcgtgagcatatagaccggaaacaatcgtatgttttcgtagctaatcatcaaggcgcgtttgatattttcttgatatatggtttcttaggcgttcccattaagtgggtgatgaaggcgggtatcgctaagattccgtttgtcggggctgcttgccgtgccgccggttttatctttgtcgataattctacgccgaaggccgccgctcgtagtgttttggaggcggagcgttgtcttcgaaacggggcttccgtggttgtttttccggaaggttcgcgtacgtatgacgggaaaatgatccgtttcaagaaaggggcttatcaaatggctctggatcagcatttgcctattattccgatcaccttaaacgggccgtttgatgtcttgccgatcgggtcgttgaatgtccatcgtcatcggatggagatggtgatccatccggcggtttctaccgagaatatagacacttcccacaaaggaatgcaagcgttcgctgatcagactcaagaaatcatcgcatctgccttgtgggaagaatataaataatttaggttattatttccagcttttcaagatgccacgtttcgctactttcaggcagaatccgaagttatcgccgaacatggaaccggcatcagctgccaaagaccctgtaaattcccatcccgataaacggggatgttgataagagatatctaaaagtccggaagctcctcttttcttgctaaggaaaggggtggcatgtctaccccaactattcatcacggtgactaatacccgataagatacttgtgaggagatagcgccttccgcaccgaaatgccagtcacgaacacggttgttcttgaatcctaatgaaccgttctcgttatactccggacttgggatcagaggagaacctatcgcccggttaaaataagaggctccggtagtgtattctccgttgttataataatcatcaccaccgccacctacgccgggatgtaggtcgtgatcaaaatcgatgaagtggaactgtccgctttggtctcttgtaaccagatactccacgaccaccttacgcaaccacgggaattttggtaaatccaattgtcctccccataatccgtcggtattgtttacgaatatcataccggatttatcctcgaagaaatgttggtaataggcggatacttgccagttaggttgtgtaaaagccaatttgaaatcgtaagagccataatgattacccagtacgttgatttgatcggagactgttgcgtcgccacccccttcgctgccgcaaataacccggataaggtccttgatggattgaggctgctttccgatcttaggattggttgaggttcctccccattgtgcccaatgctgtactccgattacaccggataacgggaagtcattgcgtgtatccttaatctgtacaaataatgatttatgatgccataaaacgttatctacataagtctgcttattgtttgtgaagttagccagataatccttgtcgaaagaacgaccgacggcaaagtctcctttgacttgcatccagcctttcgttaaaggaacgacggtaaattccggaatactgatgttcacttccggtatcgggcgggcattggcggattgcacgatatcgcccgagctaagccaacgatcccaaagtgaattatagcgttccttgcttcctacactcaatagcaagcatttgtaacctaactcggcatatatttgttggataaagaaattgcgatgacgaggaactgcggccactacgtctaatccggctccccagcgaaaacctttgccaaaagtttgattatggaatactcccgcattcaaatatccgttattcgcttccaaaggaacaattccgtatcgattgctaaccatccagaaaggggtattgtcgccactagctaccgatccgaatatttcggccttgtaggtagtcgcttccggagttgtctcttcttcttgagcgaaactagccgttgccatccccagacaagtcagacctataaaaattgatcgcactgatttcatgtatatataaatgttttgtctgggcgcaaaggtaaggatttatatgtttggtgcaaccattattgtttctttaaccactcgaatatagtttgataggcatcgttccgatagggcttttgagataggatcagatcgtggatgccgtttggaatggtatctctcgtgactttgtctcctagtttctccccgtatttttgaatgtcttgaacatccaagacgatgtcggaggtcatgtattcctcatgccatgtctctgtttccggaaaagatttgttggaagacatcactagtatcggacaatccagttttaaccctttttgtaccgtctgttgcgcttcttgtatggctttgatccatccggcttttttcggatgcccgaatatcattttccagttcgtatcaaattcccattctcctttatactgcttaagcaggctataagcgtaattcggatcacccaaaccttgtacggtaagattcggaaatagcctcccgacaaacgcaacggttggcagtacgactttctccattaaccatccgaaattccaatctagaaaagggctgttcaagataagcccgtctatcggtaactcccctttcttgctattcaaataataaggtgtgatcaacccgcccgtagaatgcgccattaataatatccgttcattaccttcggaccggatggtggctaaagcggtatcgatatcagcgaaatactcttttaggctcttgcaaaagaacgggttttgattgggtaatatcgaacgtccgtatttccgcaagtccatcgcatagaaattatatccgtgagcgtttacgctatcccctaattgtttctggaaaaaatagtcattatagccatggatatacagcacggcctgttttacgctatccagttgaggtttcttgaccagtgtgcaaactaccttcccctcataatcatccggcatctggaaggtacggcgtaaataaccatctcccaatacatcgggtacgtattgggcatatacctcgcataaaatgaaacagaggaatataataagatttatttttcgagacataaatatattgtttctattttataactgtatttgcaaagatagggtttatcaatcaatggtaattaaccaagatcataaaataaaaaatgacagataagcatgaaaaacgataggataaacgtaaatattgcaacttatacgtaaaaagcactatttatggtaagtcgttaattttttatcttaacaataaatattttactttgttggaaaatggaagcgtgtatggaaccggaaataacagtaataatcatagatgatgaccttggatcgattcaaaaattgcaaaacgatctattggccttctcggaaataaggatattggatacagcgacaacggcggaattgggcaagaggcatatccttaagtatcaaccggatttggtgtttttggatgtggaacttccggacatgtctggctttgatttgctggatgatatacgggatgatattcttccgaacttgagagtcgttttctatacggtatacgataaatatatattggatgccctacgtgcctctgcgtttgattatttgttaaaaccttatttaattgatgagttagcggcactcatcgaacgttttcatacgacagaacctgcggatgttgcctgcatggagagatctttgcggaaaatattgaatcgggatagtcgatttgcgatccaaaccgtctcgggtcttttactagtccgttgtgaggagatattcctgtttcagttcttgggagaccaacgttgctggcagattgtcttgacttcccgtactactcataaactaaaaatgagcacgacagcgaaagatttgttgtctatcaataatacgtttgttcaaataagccaagattgcattgtgaacttgacttatttgatgttcatcgagaataagaccttacgatgcgagttctatccccccttccaagaggaggagaggatcgcctcgcatcgctattttaaacaactgagagaacggttggatattatttgatggttactcttcttttctccctaattttatctgttttgcagggtgtaataggcttctgaagtgaataactaacggcttgtcgagtgaataactaacggctatacctagccgcagaccgtcaagatggagaccgcccatacgttgccggcgaacaccaccgccaccctctccaagctacaagccggccaggtagccaccttgaacctgggcggctatacgctcaccaccgggcagaacaccctgctctcgtccggcaagggcgtgctgaaactggaaggcaccggtaccctgtccggggcatacgccttggaaggatgcctctactctaccttaggttccggccaactgggaacccccacgctaggcggcaagcccgtataccgggtcagcgtaagcggcctgcccaccaatatggggaccccgatggtggcctattaccggacacaggagccgaataccgcctacaaggcctattccgcctccgccggaagcgccaccctatggctaccccaagggcaacaggaggcgacgatagccgatatcctagccaccgtgaatgagccggtagctaccacatcggtagacgtgcagatgaaccacgacaacaataccgctaccgcgtcggcacgcctcgatatcgcttacggtgatataaaggtgaccccgagtacggcgaccaccaccgtatcctacggctccaagccttatgccgccacgccggcggcgggtatctcggccaccaaccgcctgtccatcctcggcaccgccacgccggataacggaaagaatttccagatactcgtcaacaacggaggtagcggtaccgcttacctgaacctgcggaacgtaaatatccgtccctccgggcaaaaagccgccgtactggtgaacgccgctaccgatatagcccttgagggagataaccaattacggggaggaggcagcgcgagcggtacggaacccgccatcaagatcgcttccggcagtgtccgcctaagcgacccttctaccgacagcaaaggacggctttatgcttatggaggtagctatgggaacctgtccagcccggcgatcctgtccgagggttccggcaatctcaccatagccgggggtaccttggtggcacgtagcggcgacggaaccgcctccggagcgttgaaaggaacggtacgaatacaagccggaagcgtggatgccctctgcgagacccggcctacgaataccatcggcggcaagagtacgcccgtataccgggtggacgtgaccaccggactgaatcccgaccaaccctaccaatgcctctacgcgggatgcgacccgtcgcctttcatcgccctgccggacaacgccggcaaggtctattgctggctacccgagcagaagctgagcgacccgaagaccaacgtgaccctcacccatcccgtaagctacgagaagaccgagatagaggtggccgaggtacgccaggccgataataacgtggcccccatcgtgatccgcatgactgaccgcataagcaagaaacaagcctcgttcggcaacttgcgcgacgctttcgacgccatgaccgccgggaccgacctctcgcatagcgtatacgacctgcaattgctcacccggatcaacaacctgcgcaccgtgcaggccgtgcccgccaatacggacgcttacctcgacctcggcagcttcgagatagcggcccagaacggtagcgatgtctccttcgatgcctccgccagtggcgcctacctgcaaatatcgggcaagggcaacataaagaacaccgtgaagatagcgggagacgtgttcatcaccggcgtggtaccgctgaccgatgccgtggtggagctaaacggcaaggccgtgttccgcaccctcgtgaaagacctgcccgtagccacgggcaacacctatacctatagctacggcgagcagcagaacatgccgttctacctgcacgacggcctggcctgcctctggctaccggactacgggcgcagcgaggagctacgcttcaccgtaagcgggacgggaggctcgaacaccgagtacacggcgggcaacatcaccaccgtgacccagcgcaccgaggctatcgccgccagccccgtgggcgtggtggcacggcttacctataccaaggccggatcgtccacgaaccagccctataacaccctgcccgaggcgttcgcggcagcgagcaaggcctacgccgccgggggagcgcaggatatcaccgtacatctgctcacgggcgtatccgtatccggcacgctcacggtaagcgggcaattcacccttaacctagacggcaagaacctgaccagcgcctccggaggactgatacaggcgcagaacggcgcgtgcctcaccgtatccgacggcaccgccgggatgaaaggcacgatgcaggtcaacctccgtatgctgggcacggggcaggtattcatccctagctatatcaagctctcgggcaacgtatacaagggggataccgacagccccttctattggcgcaccacattgaacatgaactaccagcccgtgagcgtcacccaagtgtccttcgagggcgtgacctatcccgtgatcgaccgggaggtatgcctctggctacccgccgacaacgacccggcgaaggtctatacctttaccctcggaggcaagacgatgaccgtaaccggttaccagatctccgccaacaagcacgacaacgacatgacactgggcggtagcaacaacgaggcacggatcggtacgcaagaacacgccacgctgaaagccgccctcgatgccgccgtgagcggaaatacgatcgagttgctgaagaccgtctcgctggccgactataccttgaacgggaaaagccttatccttgagctgggtaaatacgagctgaacggtagcgccgccgctagcgcgctgaccctcggaagcggtaccgcccttaccgtgaagagccaaggagggaacgggaagttgaaaatggatatcaaactgaacggaggtaacctatacgttgggcaggatgtggccggcgatggcatcggcacggtaagatcagccggaggaaccccgtaccaccgcttgctaatcaccaacctgccgctgaacgtaccgcccggaacccacaacttctcctatgccgacctcgacaataacaacgccgagacgggtacaccgcaaaagggtaccttcatggtccgcgagaacatcggttgcctatggctggaagaggcgatcgcacgccggttgaggatcaccgtcgggacaggtacgtacgacacggagaacgtgaccgtgaacgccaaccattacaacaccgagacctacggcgtgaaagacgtggcccagattcgcaacggaaagaaatacgccgacctgaaagaggcgttcgccgccgccgcgggacgcacgatcgtgttgctgaaaaacgcggcgctgaaagagaacgtaacgatctccggatcggtcgtgctggagatgggggaatataccatcacctcgcaagacgtgagcacgctgaaagccgccatcaccctgcctaagggtgccaacctgcaaatcaccggcaacgggagcatcaactccgacttctcgctggccgccgccccggagaacggcacttacggcaacggcaacctacaagtggacaagggcgtgaaccttaccggaaacatacggctgaacggcgaactcagataccgggtaagcatagacggactacccatctccaagaatatacgctatacgtatgagacgcaaacgggagccgtgaggtcttccgcgtccggtacgctctgcctttggatgaatgtaagcaacaagcccgcaaacttctatgccgacgataccgatggcaagagttatctggcgacccaagtggtaatcaccgccacccactccaacccgatcagcttgaccaaggtggacgccgtggccgaggtgaacggacaggcgttcgactcgctgaaggatgcctttgcgggagcggcgaatggtaataccatcaagctccgcaaggacgcggataacctaagcggtaccctcgccctcaacggcgatattaccgccacgctggatatggagggcaataccatcaacgccgccaatctgacgctcgacgcgaagaagggacaaatgctggtacaagacggtaaattaacggggacgctcatcctttcgggtaacgtattcatcgatggtgacgtgagcatgacgaacgctaccgtggcgcaggccaagaagacggtatggcgtacgttcatcacgttaccggacgctaccgcctcattctcctataagctgggcaacgagaccccggtaacctgtaccaatatccataccaatgccgatggcaagccagtggcatgcctgtggctgccttcctcaaacgttgcacgtacgctgacagtcagtacagccggaaacgaatacgcgttgagtaacgtcgtgatcgcctccacgcacggcaatgagctggatatcaccagtggcaacaatccggtggcgaaggatggcaataacaagcaattcgcctccttggcctcggccttggcaggtgccacgggaacgatcacgctgatgagggatctcacgctgggtaccatccaatcgatcacgacgagtcgtacgatcgacctagccaacttccggatcacttccaccaacggtgggttcgacatcaacgccggcacgacactcaccttgcagagaggacaggtattgggtactctcagcctaaatggtgatggaggggtttccgccttaggagacgtgaaaatagccgggatcgtgctggataagaaccatgaggagatttatcgtgtattggtgaaagtaaaggacgctacccaatgtctttgggtaaccacctccaaggtggaggaagaccggacgatacagacgaatcatgaagtaaccatccccgccggattgtccaaccataataccacgctgaccgcttatgaggtgaagacgctagacggcgccggtagctggcaggccacctacgtcaacacccgcctcaagctgggcgctaacgccgtattgaccttgccggaaggaaccaacgctaccttgaatcgcttgatcttgcgtgacggggcgaaagtgaccggaaaggggcaggtgatcgctacggaaggcatccgctacgttcgtgcgataacggctggaaaatgggaatctatcgccttgccgttcacggcatcacggatcacgatggcaaccgacgcgggagcgacgacgatccttagccccgcctacggaaacggcaacgccggaaacttctggctacgtatggtaagcaccaacggggcgcttatcaacgtgaacagcccggagatgaccgccaaccagttctacctgatcgccgtgccgaacgatctgggaggcaaggagcttaccttcgtctccggcgctaaccaattgctccgccgggataaggtactggccgtgaagcccgccagcggattcgccgcctacgctaacgggacgctggatgagatacaggtaagccaaccctgctacgtcttgaaagctgacgggaaatcctttacacgggtcaataccgccactataagtcctttccgcggatacttgctggcggatgccgccactaccgccgtgaccccggagttgcgtatggccgggatacctaccgccaccgagaccatcgtaccgggcgagccactacgggtatccacccgccggggcgcactcacggtatccaccgggcgttctgtcacggtacgcatctatacgatgaacggattccccgtagagagcttcaagcttgattacggcgaacgtaccgtattcctacctacgggtatctatatcgtgaaccggcagaaggtatgggtagactaacattaatatatatacaatctaaatacgagtaaagatgagaagaaaactgatatatctattcctgttttgcgtggccctactgcggggtcacgcacaaggtaccctggtaccacccgatgaggggcctgatttcaattgggagatcgctacgatgggcggcaagagttataactcgctggaagccgctttcgagaatttgaatcaagacgggcagatcatcaccttggtgaacggtactacagtaaagaaagccgtaacggtggattatacgaccacattggccctaggtggcctaccactggtatttaccactgacgcccaattcaccatcggtaagggtaagactttctatatgaccgggcaaccggagattcggcacagcggctcgttcaaactgggcggcgaaggtaacttcttcgcaggggccgacgtgaatcttacgggaatcagcgtgctggacgccgcccggcccgccgtcaacctgtaccgggtattggtacaactgccctccaatgacggtgaggtcagtaaccttacgtacggtaaacagaccgtgactcgtttcacgcagaaagacggtgtcctttgttgctggctcacgcaaagcgtagccacgcaaacgatccagttcagctatatccccaagggggggactaacgagagctacgctacggctcccctcgccgtcacgctccatgccaacacagtcattacctgcgccaaacaagatagtggcagtggtaccgtaactaacgttgcggaagtgaacgggaacgtatacgagacactggggaaagccatagatgccgtaaagacgggaggcacgatctcgcttatcaataacgccgtgctgaacgaggtggtgaaaccgaccgggaagatcgtcctccaattaaacgggttcaccctctcgtcctccggcgtagccggaatggaaccgggcgagggaggcagcttcactatcgagaaggggacaaccgccggaggacgggtaacgggtaccttctctataaacgatcgttgccaagtggcgggttccgtacccctcacggctgcgatcctaagaaatggaaagcaggtctatcgtacccgcctaatcctgcccgctgatgctaaagataaaaccgtggcctatacctacgccaacgagaccggacaggcactcaccccttccatggaggaaagcgagcttatcgcttatcgctggatggtctcacacagcccggcgacattcgtcctcagctacgacgggaaggctgttacgctttacgatatagccattcagacgaaccatgacaacaccatcgacctccgtaaaggagcgatcgaggcaagcctgtacaataacgccgaaggtacaggtacgggaacggattacgcctccttccatgatgccttgagtgacgctacccggcaaaatgggagccatctcttcttgcgccgtaacgtgaaattcggtagcaatgacacccacaagctcaatcagaacgtaataacgactctccatttggacggccattccataaccgcttccaacagcttgctggacgcttccgaggaaggagccgccttcatcatccactccgaccggggaaccgggcgcatcaccggaaatctccgtatcgccggagacgtgtatatcggcaaggaaacgatagccggcaatatcggagtcgtgcaacagggaaatacgcccacacaactctaccgcctgctcgccacgatagagagcgaccagaaacccaccgacgggatctatccctacacatggggagaacagatgggtacttgctacctccgcaacaatatcgcttgcctatggttacctaccggacaaggggacgttaccttgcgaataggcgataagacctaccggacaactagcgtaacgatcagcggtacgcactcgaacacagtcatcctgcggaaaccgggtgtggtagcgaagatcggcaatacctcgtacagctcgttacaggaggcgttcaacgccgccaaggataaggataagattaccttgatcgcaggaacttccctaacccaagatatcggtttcggtaatgatctcacgttatcactcgacctaaacggacaacagttggcctgctccggcaaggccgcgttcacgggggctggaaacttgcacatctacaacggagatatcaatggaaccttacaagtctcctccaccgtaatcatcgataataccgtggctcttaccgccgctatcctagagaacggacgccaggcataccggatgcgcgtggagctacctacctccggcagtaacttccgctacagctatgaccagacgaaggcacggcccttatacgagctgaacgaaggcgggcaaccggtagcttatctctggcaacctgcgcatgcggccgctcctctcaccctgctccttaccggtggcgatggaaaggaacaaagcaaaacgaaatacgatgtcagcatattaccccatcacgacaaccggatttccttgaaagagggagatacggaagcgatcctattcccggatggcaaggatatcgacaagcctactgaagggattccttacgaaaccttccacgaggccttgaacgcagctggcaacatggataaaagccggttgaggttgcgccgtgacgtacaattcagcggacagacaacgcacacccatacgatcggtaaggatatacataccgaactcttgctggacgggcataccgtaaccgccacaaattgtgtactggatgcctccgcccctaacgcctacctctttataggcgacaaggaaggacgaggacgtatagaggggaatttccgcatccgggggaacgtatatatcggacgggatatcccggctgggaatatcggaaatgtttcttccgccgatggtagcaatcctttgctgtaccgcgtattggcggtcgtgaaaagcgacgcgcctatttccgacagactctgttcttggcaatggaacggggaagaaacgcaaacatgttatttgtcggacaacacggcctgcctctggttacctctcagtaccctacatggaaccctgcgccttatcatcgatggcgattcctatacggctaccgacgtacaaatatcggcctcacatggtaatacggtaacggtaaagaaaccggatctcatagcccgggtcggcaaccaagcctatacctccctcgaagaggcttttgcgcatgccggtaacggacaggcggtcattaccctagagcaaagcaccactttcaattcaccgctttccgctgctaacggccaacaaatcacgttaaaactgcaagggaatacgctaaccgcacaaggggcggccgccttgcggacagaaggaacagggagccttacgcttaccagcgataccgggcaaggaaccctcgccgggaacctgaacgtaacaaaggatgtaaatatatcgtccaagatctcgatctccggcctcgtacgcatggatggcgtaaccgtttatcgtacccgcctcttcctgccggaagataccgaggccgcccgttaccaatatgacacgcaaagcggagaactgcgatttatcgatgaaaagaatagcctagggcaaacggttggttacgcttggctggagcccgtgaccggtacacacgatctcaaggcgaccataacccgtcccgagccggaacagaccaagacgcttaccgaggcgatcgtgcaggccacccacaacaaccaattcgatatggaagcgggcaataacgtggcctccctcaacggtgtttattatcccacgctggcaagcgccatagaagcggcgaacaaggcaggaggcggaatcatcaacctgacacatgacattaccttgcggggaaccctcgtgatatcccgggaaataacgatcgacctaggagaacacaacctagccgccaccgctgacgcggcctttgatattagcagcaaagcctctctccggatcacggacccgaccgggaagggaatcgtatacggaaccttcctgactgacggggatctggtcgtagccaaagaggttcgtctggctgctaccgtaatccatgacggcggcaaggtataccggatgatgatagatggcctgtccgtacgggatacggatcatctgtcctatcatttcctgacctccggggataaaggaaagctgtcgtacctagacggaaccgcctatatctggttacccgagataatccaagaggaagatttacggatagtggcggataacgtcccttatacggctctcgtacgaccttttggcacagggcacgatacgatattgaaggcctatcctttccgtttggtaaacgataacgagacttggaatgatgccacttacaaggatgcggacatagagatcgcctccggcgtaacactgacaatcgacacccaagaaaaattagggactatacgccgcctaaccttgagagacggttcacaactcgtaaccggagaccgcatattggcaacagaaggtatccgctataaaaaaagcttcgataagccgaatcgctgggagaccttctcgctcccctttgaaccgagagatatcacagcggagataaacggacagtccgtttccctctccccatacctagcttccggtacaggtgggcatttttggctgaaatcattacaggacgaccacacgtttacctatgtagacgaggagcgcatcttggcgaataaagggtatatcatcgccgtaccgcaagacctatccaccgagggagggaataccggaagacggcttatctttatctcggcaggcaaccagttcctcaaccgggcctctctaccggccacgttaccggataataagcagatggaactaatggctaccggaacgctccgagatcgaatcatgaccacctcgttctacctattgggcaaagaaggtcaggagttcatccggcaagatggagtatccgcggaaaagccccggagcatacggccatttaccgcttatctgctggtagagtctggactcgctgccgctaatgccagtttccgtttagccggtctacccactggcaatgagataggggtagcggaagaggagagtctacccgattacagattatatggcgagagggagacactcgtaatagagagccgtaaagcctccgagatcagtatatatagcttgaacgggcaattaatcattaaacggcaggtagctatcgggacgacccgcataccattacctaccggcaactatattatcaatcagactaaaattcatatcagataacatgagaccaagaacaatcatacaaggaatcctgtgcttattcctgcttatgctgagctatgcgacagtggcacaagatatcgtagggccggacggacccgatgatccctctaccctagaaaagtatatcaccgtaacccaacatgagaatggcacgatcttgccgaaagggaaagatgggaaggtcaccctttattcgggaaatgaccagaagttcaccattgcctccaatcccggctatgcgatcgagcaagtcatagtggatgggaaagcgctccttcttgataaagggcttacctcttatacctataccttcaggaaggtgagcgacaacagccacagcatagaggccaccttccgtgcctcccgctttaccttaaccggtatagccggggcaggtggatgtatcattccggctacagcaacgatcgatgagggtggctatcagttattcacttttacggccgataccggattcgagatcgacggaatacagatcgataacggtacccttgacccggctttacggggtaagaccgagggtacctacctattggaaaacatcaaggcaaatcatgccgtgaaagcgatctttcggggaaagcaacatgccgtgacatgggaggcttccgaacaagggaacctgatcgtgaaagggccggatggcaataccttgtcttctggcgataagatcgcctatggaagcctacttactatcgagactaagccccatgcgggatatgagagcgacaaacttaccgctaacgggatacggatcaacggacatacctatacgataaccggggatgtcacctttgccgcctcattcaaacaggcgaactatacagtcacggtccagaccggttccgaaggagggcttcttacggtaaaaaatggaaatacaagcttgggaaacggaacacatacattgccatatggcaccatcctaaaactatcggccactccacggatagggcatgaactgaaggagtatagcgtggcaccgaccggatcattaaaaggtgatgtggtgaccataacggaagacgtttccattcaagcgatctggaaagcgatctcctatccgctgaccgtcgcctcacccgatccggcggatggtacgcttctaatcgatggcatcaccgccaagaatggtacctacccctatggcacgacgctcacgctcgagaacgccccgaagcaggggaagatactggactgttactcagcttctcccgccgcagccttatctggcaaccagcttacgatcactgccgccactaagcttaccgcacgtttcaagcctatcccaaaagaagaggaggcggttgatcccgaagacgggaaaaaacttttccgggttactttcccctctacattgacagtcatgaacggttcggaagcaatcggcaacaatagtcttatcaaagaggggactctcttgactctaatggcagagaataccgaagccgaacaactcagttctttaacagccaatgggaacccgatccgtttccaaacgactggctacttgaatatgggtggccatgtgttaaacgttccgacacagttcgccgccactttcactccaaaccgctataccattcacatcgataccccacaaggaggtaccttaagcgcaactatagatggagttcccgttctctcgggctcagtttatccccacggctcagatatccgcataaccgccacacccggacaaggctacaagctcacacatatctgggcagggccgcaagatatcaccgacagccggagaatctccctcaccgcccccctcagcctatacgccgagtttaaacgggaaaccgagatcggtaccaataccgacccgtccgatcccgatcctgaatctccccttgggatcgacttatcaccccaatccgtaacctatgaccggaaagagcagttcttcacgctggaggcattgccggacggcttgatggacaagatcacgatacgataccggcaaggggataagtacgtgaagcccgtaaatgcgggtgtctatgacgtatacatcgaccgcccggcggatgaccgttacccggccttcagcgagacgatacccgccgggctggaaatacggaaagccccggtcagccttacggatatcaagtattcagaggagcagattttgggcaaccaacctaagaccacagcggtattgcaaggtggcgaggccgaatatctgggccaagcggtggagggaacctttacatggatctccgctttagcgcaaagcaaccggctgaccgttacccgatcctccatagaggaggtacgcttcacaccaaaagacgagacgaactacctcaccgcatccgccaaggtacggatacaagtgggaacggagtcttcgtcaacctacaagataaaggttacgaccgagggggaaggctcggtggaatacctaacaggctccttgtggtatccgaaggaaggaccgttctatgaggatatggagctgtccctaaaagcaatagctggtaccggacatcgtttcgcaggctttctgatagagggcataacctatgcccaaagcccctatacaatccgagtctcgaaagacatggaggtcaccgcacggttcataccgaaagaggacccggcaaatcccagtgatcccacagcccccgatgcactgaaggtcaccattgacgtaccctctccttgtgtctacgacggaacgcccaaactggtaggagtgtcatccacgccagctctgaagggtttccaaattaaatatctcgacaaggacaagaatgccgtgatcccggtggaagccggtacctaccaagtgatcgtaacccgcccggaagacgagatctataaggcctacagccgtaccgtgtcattgaccgtcagcaaggcatcgcccgtgatcacccggctcccaaccgcctccgtgataccggtaggagctccactggaggattcccggttatctggaggggaagcgaccgtgaacgggacaagaacgatcccgggtactttcgtatgggcggagccggagaaaacgatctcgcaaaatacggaggagcccgtcgtgttcactcccgccaacacgatcaactattatagcattagcgaccggtccgttccggtgcgtataatccagggcagcgagcctatcccagtcttgatcacctacggccaacccgcaggcggcaagctcataatctcgaaagaattggacgagtcccccattcccagcggtagcttactggatccgggaacggagatccgtatcgagacacgaccggataacggcatgaggctgtatcaactccatatcggtgacgctgactataccgccaaggccatcgccgggcaatacacgatcgtacggaagatgtacacctcggcgactatcaaagccgtcttcaccgggacaggtacaaaaccagacccagaccccaatccagacccgaatcccaatccgggaacagacccgacaccgggtacaggcacctatacagtctgggtatccaagactgggctaggcaccgtatcgccggagaccagcaaggtccgttggggcgataacctgtctttcaccatcacgccgggtagcgggcaacaaatcgtggacgtgcgcttgaacggcaacagcgtgggagccgtacgtaactatacgctgaacaatatacaggcagacgcctcgatcgaggtggtcttctcccaaccgggaatacccgtatacacattgagatccataaccgagggcaaggggggagccgtaagcccgacaattgtcagagtcacggaaggaagcaaccatcgtttcgtgattcgcaaggagaataagggtcagatcgtggatgtctgtatcggcgactcaacaagtctggagagtatcggcaagccgtctagctacgtattccagaacgtgcgggcggactccttaatcgtagccactttctccatcccgacctcgaaccagtcgatatccatggaagagtcctgccatatctcatccggatatgggtacctacaggtaacgccatatcggggaaatatcctcttacaagtatataaggcagacggaagacttgttttcaaaaatcgagtctccgagcaaaccttgatccaaggattacagacaggtgtctacctcttggagatatatcaaaacggacatgtcaggaaagagaagatcgccataaacggcttctgataaagcgatcttaccctcacccatttgaaggtgcatcaaaaggtatccctaccccctatcccaaagaaaagggataccttttgatacgccttcaattattaagtaactattactttatacaaccgtaatatccctgcaacaccccgctaatatctttgccttcgaaattaatagacacagaatttaatagaagaatcatggaaaggttatttaaaatcagaatctttacggttatgttctttttagccgtagcttctatagcagcgaacgctaaagaaagtaagaaggaaggtgacaattatcatgcgaagcaaattctcatcgtaggtttgcacgataacgtgaaatcaaactatttctacaatgggatgatcgccgaagagaccggtatgaaagcggatagtatcgaccaaacgtataatacgatcatcgccgagaatatcgccgcatccgtaaagaacggagattgtaagtttattccggcaaacgctacacaagtgaccggacaggtactgaatgagatcaaggtgaacggggagagcgaggattgctattccgatctttcagccgtgccgaccgaagagttacaaaaggtattggataatgccgacgctgattatctgctggtattaaaccagcattatcttaaatggcaagaccaaccgttgcgcacacttttccatatcgtcagctataccctattcgataaagataaaaacgaggtatatcgggggaataacttctttacctgtatgaatcttgagaatccggataaactcagaaagagcagccgcaagagttcatccaagatagcatctagcattatcaaaacgttggatgaggactaaccttcttctttatagacacatttataattttctcgttgagcctaatggatatccttcattaggcttttttctttatttaaacctacacacggatgtaatctctttgcaaaaccggacacttacttttgcgccgtaaaagatatttaggtttaattttaaaaagattgttatgaggatgtttaacaaacgaattacttgcaggttacttgcctgtttgttattttttaattgcttaccggctctcctattcgcacaaggaacgcaagccattatcaccggtacggtcgtggataataaaggggaatcagtgatcggagccacgatccaagtcaagaatgaatctaccggattcttcacgggctctatcacgaacgataaaggagaatacaccatcaagcagcttccgctaggttctccttataccgttacagcttcttatatcggttatggggaacagaaaaagacaggatacgcattgaaccaaggggatatgcttcgagtggatttcaagctagcggaggaatcggtggagatccaagctgtcgaggtagtcgctaattccttgaagaacatggttccgaagatcggcgcggcaacatctatctccgctcaaaatatcacgaagcttccggtaaacggccgtaacttcacctccctgatggatctctcgccattgagtagcggaggaaatatcgccgggcaattatcatcctcaacgaattacaccatcgacggtatgacggctaaaggaaccgtagcgagcggaacgacttccggcgcttatacgatatccatggaagccgtccgcgagtttgaggtggtaaccaatcaatatgacgtgaccaacggacgttccgggggcggcaccgtgagcgctgtcacgaaatcaggaaccaatactttcaccggaagtgtattcggattcggtcgtgccgattggttatccagttcctatgatatacggggaaataaatcgacttccgacttctctacctatcaatatggtttctctttgggaggtccgatcgtgaaagaccgtgcgcacttctatgtcgtatgggatcaccaacaggattcccgtccgatttatatagcggatatcaagacggcggtggacgagtctcgctataatgtcactcaatctacgctagaccgttatctggatatcgcccgtactaaatacggagtctcgaatgagcctcaattcggggagttcggtaagaagaagcagacgaacgcggtcttcgcccgtatcgactggcagttgaacgcaaccaacttgttaaccattcgcaataatttcatcaacgaggataataaacagagcgagagcgataactccagtatcaatctctacgaggtttggatcgatcgcaaatcgcataacaacagcttacttgctaccttacgctcggtattaagcccaaagctgaccaacgagttgaagcttcaacatttcttggtttacgaggccacggccccgaacaagcaattgccaagctctaatatcccaagagcaatcgtagagaacgtggaatctatatctggtgacaagagcatgtacacttccatccaacttggaggtcaacgctacgctcccgaacatttcaaggataatgtacttcaattggtagacaatatgtattataatacggaccgcatcaactatacattcggagcggacttcatgtacaccaatatgaaatcactctacggcagtgagatgaacggacggttttatttcacgggactggataatttcgagaatatgactccttaccgctatgcccgggaaatcgccttggtagatgatcctaccgtaaagatgaataccttgaactccgctatctacggacaattacaaacgaagcttttcaccggattcgaggtcatggccggtatccgtgcggattatacccgctatttcaaccacgcgaactttaaccagaccgtttatgacgaactaggcttacgtacggacaacgtaatctccaccttccagttgcaaccccgcgttcaattcacgtgggacgtgaatgataaacatcaagatattatccgccttggcgccggtatcttcggttcggatttaaacaactattcgatgatcaacaatatgctgttcgatggtacgaaggtagcgtccgtggatatacaaggcaatttggttccgacaccgaatttcccggcataccgaaaagatccttctaccgctccgggcgttgatttattcaacaacccgaatatccaaaagatcagcacgatcaatatgaatagtaaggatgcccgtgtaccggtagtatataagttgaacgccagctacacgcatttcttctccgatcgcttgcgggtaggtatcagtgcttacgccaactgggcacgccataattatatgtacgtagaccgtaatatggtggatgagccttacttccgtatcgccgccgaggggaatcgtggcgtgttcgtccccgccgagagtatcaataccaagaacggagctaccgactggatgcaaggacgtaaaagtgataaggtaggccgtgtgctggaattaatcagcgatggaaaaatcaaccaatacgcgctcgttgtagatggaacttggcgttatttcaaggatggcgagctttctttcagctatacgtggaacgattccaaggataacacctcttacaacggtaacgtagcgaatacagcgactctagccttgatggtaaaagatgatcctcgtgatttgagtaccatgacttactcggacaaccaattccgccataaggtcgtattctacggtacggctccttctttctgggggatcagcgttggcttgcgtttctccgggatcggtgggacccgctactctttagcggttagtggtaatatgaacggtgatttcgtatcatctaatgacttggcttatatttatgacccgaacgatagtaatacgcctcaatatcttcgtgagggtatccaagcgatcttggacaatccggaagcggagaagagcgtaaaagattatatccgtaaaaactatgggaaggttgccgagcgtaacggtggcgtaaatggcttctacggtactttcgatttgcgcttgaacaagaacttcaagatctataagactcattccatcgaggcctcgatagactttttcaatttcctgaatatgctgaacaaggactggggtgccggacataatctaggcaagcagaatatctactccatcaagagttttgacgcggagaagaagcaatacgtatataacgtaaacaaaaacacgggtgtatccaatatgaacggaaatccttggcagattcaaatcggcgtacgttataaattctaactaacatattctatattcaaatcataaaaaaaattacgatgaagagacaattcttatcattcacgcttttacttgcgttatccacttggatagcgcaagccgctaccgtaagaggcactgtatccgatacggcaggcaaaccgctacaaggcgtagtcgttacggatggttataatttcacgcaaacaaatgagcggggagaatatagcctagattcgaatctggacaaaagccgctttgtctacctctccgtaccgggtgactatgagatcgagcaaacaaaaggtataccggatcttttctatcagcaacttgataaaagtaaggagatcaatgaacatgattttacgctcacccctaggaaacagccaatcgacgggtttgtctacttggcaatctccgatcctcagaccatcgacgaacggcagatgaaacgtttccgtgaagagaccatccccgacttgaagcagactatagagcgctaccaaggaaaagaggtctacggtatggcgctgggagacattacttgggatcgcatggatttattcactccttataaggaagcggtctcggtcttaggcatcccgatgttctccgtgatcggcaatcacgaccacgacttacgttacccggccttatccaatcaaaaggtaaccgaggagagctacgcggagcgtatctacgaggatcatttcggcccttacaattattcgttcaatgtcggggatgcacatatcatcaccttaaaagatattgattattataaagacaagaaatatgacgaacgcttcggaaaggaacaactggaatggctgaaaaacgacctgagttacgttaaacccgggacacttgtatttatcaacgtacatgccccggtattcaaccagacggataaagggggaggaaacgccgaggacgctgagagcctgaaagagatcgtcggcccttataatgtccatatcttcgccgggcatacgcatttcttcgagaacaaccaagtcacaccgaatctgtacgagcataatatcggagccgcttgcggagcttggtgggccggccatgtaaaccggtgcggcgccccgaacggttatctggtcgttgaggtgaaagggaatgccactacttggtattataaggcaaccggccatgattcgggttatcaattcagggtttataagccgaatgagttcaaatcgcaagcggattacctagtggtgaacgtatgggattgggacccgacctaccaagttacatggagcgaaaacggcatagagaaaggtcgcatggagcaattcgatgatgaagaccaagactatatcgacatgcacggaaaaccttccggatatcatacatcgcacttattccgttgccacccttctgccggagtcaaagacgtacagatcaaggttatcaaccgatttggcgagacctttactaaaaatgtaacactcccgtaatcaaatcgtaacaagtggcatttacttttgtatcgataaaatgtagaaaactctcattacatattaatgttagaatcattacaaaggaacaaaccaaaccttattcctaactttgaacggcaacttggctttcggcggaaggcggttgccgttatttttttaagggtatatcctattcttaacgggaaaagtttcgagtatggacgatagatttaagacattagagaagtataacctatggggtggaaacgattttccaacaggctataaacggcaagattatttagataggatattatcctacatcctataaactcataaacggaggccttggcattttgtcaatttgtaaactcaactgccagagaatcacttttttcgggcaaacgtacagcttatccccaaatacgagaaaaaatattagcaatcatttgtcttataccgcattaattaaaaacagccttttatcctagcgaatttaattcatcctaattcatatcctatagcttatccgggctatctcattgagttacgacagggatataacagggttacgatgcccattcatgagtactaacaaccctattcatgactgtttacgatgcccaacggcactactggcgttgccaaacaccactagtcgtgttgccttttaccgcctgtcgtgtataaaaagcggtccttttgtatgaaaaaggctatttatacccctccgatctcccctactttatacctctctcaaaaatggtgtgtcacgatatctgccttatatcgattaaaaagatcgaataccgtccatttcgctaacaaagcccttacccatccttatcaacaaataaggggaaacagtgtaataccgtctccccttgtcttttatccgtttccatcctcacggaagtacttacggatgaactttaatttattactttagtattatagatttaaggttaacaaagtttggttagggcttgtcgtgagacaggctttaattatttataggggtttcattcgtttatagatgcttcccggcatcgattttatctttccatccaattccaactcaaagagcagagaagataattgatgtaccggaagattcaaggctacggacaattcattgatatgagattccttttgcgtctccaagaacgacaagatccgttcactctcctcgttctccggaaacaataattgggtttggaccggtaacgcgtctgtcttttgagcgacatcccaacgcatcgccatgattaaatcgtcagcgcaagtgatcaagcctcctttattctgccggattaagctattacatcccttagagttgatatccgttacccggcccggaaaggcatagacatcccggccatacgagaaagcgatatccgccgtgatcaaagagcctcctttctccgctgattcaataacgatcgtggcatccgccagaccggctacgatccggtttcgccggataaagttctgccgatccggattcgtcccgctaggaaagtcggtcaacaaacctccccgatccaacatttcgatcgccgtagagcgatgcacgggaggatagatacgatccaaaccatgcgccaatacgcccaccgtgggcaattggttcttcaacgcattccgatgggcacaaatatcgatgccatacgcgagtccgctaacgaccaatagatccgggaaactcacggacaaatcccgcaataaacgctcggtcacttcctgcccataagcggaggccctacgagtacccacaacgctgatgatatgggcggcgtttaaatctgcgttccccttgaaataaaataaaaccggagcgtccgggcattcccgcagacgttccggataattcatatctttcaagaaatagatagagataccgttcttttgggcaaaagccaattctttctctgcccgtaagagcacatccgcccgcttaatctcggcgataatcgaatcgccgatacccggtatcttctctagcgactggcgcttttccgtaaacacggcctccgcatcccccaacgcttccagaagatggcgggctaggatatctcccaccccattaatcatagtaaggccaatttggtaaatctgtttgtctgtcatttatgcttgttttgattctattcgctttagcatctcatcgaaatattctcctctggttaatttgccattctctacgacaacggattccacgactcctttagtagccagcgccccatcggattcccggtaaatatcttgctcgaacaccagtttcacccctttcttatatacattcaggcaagaagtataccgatcgccgctccgcaaggagttcttgaactggatatccacacgggccacaaaagcatcgatgcccttctcatgcatggcgccaaagttctcacccaacgactccagaaactcatgccgggtatgctccatataatgttggtaattggagttattcaccacgccttgcaaatcgcactcataatcgcgaaccttgtctgtcagtttaaaaatatattccttcattatcgtagttctttttcgatttgtactttctccattttataaagacgatcggacgggcggatcttctcggacatctttatcgagaagcgttcccctttcacggtctcctccaccggtttcaggtctacccggatctcatcgacggtctgcataacggctccggtcgtgggacctgttaccaagatctcatcgcctactctcaaggaaccggactccatctcaaactcggcgacaccgattccgctgaagtatttgataccccgtgccacgtacactttcttacgggtagcaccggagccatatttactgctccattcacccaatcgttgtcccagatagtagccatcccagaaaccgcgattaaagaccctgcgcagacgctcgtcccaaaccgctaccttctcctcatcgaaggtaccttcgcaataggccttgaccgcctctttataacattcggtcacgagacgcacatactccggcccgcgggcacgcccctccagcttgaacacacgtacgccggcatccatcatcttattcatgaaatgaatcgtcttcaagtctttcggcgacatgatatactgattctccacatccagctcgatctggctatccttgtcatgcaccgtataggcacgacgacaaatttgcatgcaagccccccgattggcggaagcgttcatctcatgcaaactcaaatagcatttaccggacacggccatgcacaaagccccgtgagcgaacatctctatgcggatcaattcccctttcgggcctttgatctgctgcttcacgatctcctgataaatctcatgcacctgctttaagttcaactcgcgagccaatacgaccacatcggcgaagcgggcgtaaaacttcaacgcctccacgttcgagatattcaactgcgtggataagtgcacctcttgcccgatgctattcgcgtaactcatagcggccacatcggcggcgataatggcggagacacccgcatccttagcggcgtctatgatctccctcatcaacggaagatcctcaccataaataaccgtattaaccgtgagataactcttgataccatgttccccgcaaatagcgacgatcttacgcaaatcctccgtcgtgaaattattcgacgagcgagaacgcatattcaatccctcgataccgaaataaatggagtcggcccctccttgtatagcagccatcaacgattcataggaaccgacaggcgccattatttcaaaatccttctctttcaaggttatatattttaatattacggtagcaaaggtacgaataatatttgagaagatttcttataagcacaaaccctccatcccatcatgaaagaatagttccagttggagaagcacaagatcctaaataaagcggggcaatccgagctctatcaatatatcataaatgatccggattattaaaaacgcctgttccatccaccgatcatcttacgagatgtaaaaattattccccaaaaagaagtacttttgtaatctctatttagttagcaaacagaaggtatgaagattggttcaatagatttaggggagcgtccggtattcttggcgcctatggaggacgtgacggatatctcgtttcgtttgatgtgcaaaagcttcggggcggacatggtatatacggagttcgtatcgagcgacgcgttgatccgcagtgtgaacaaaacacagcaaaaactaaatgtctccgatgatgagcgtccggtcgctatccagatttacggtaaggacgtagcctcgatggtagaggccgcacgtatttgcgaggaagctcgtccggatattttagacataaactttggttgccccgtaaagaaagtagcaggcaagggagccggggccggtatgctacgcaatatcccgttgatgctggaaatcacgaaagaagtagtgaaagccgtgaacatccccgtcaccgtgaaaacccgtttaggatgggatgccgacaaccgtgttatcgtggatctggccgagcaactacaggattgcggtatcgccgccctctccatccacggacgtacacgggcgcaaatgtacacgggcgaggcggattggaccttgatcggtgccgtaaaaaataaccctcgcatgcaaatccctatcatcgggaatggcgacgtgacttccgccgagatatgcaagcagcgtttcgaggactatggcgtagacgccgtaatgatcggtagggctagcataggccgcccttggatcttccgggaggtaaaacactatcttacgaccggggaattattgccgcaagagcctttctcttggtatctggatatcctaaaaaaacaagtggagcaaagcgtggaacgattggacgaacgtaggggaatcttacatattcgtcgtcatctggcagctactccgctcttcaaaggtattaccgatttcaagcaaacacggatcgccatgctacgtgcggagactgttaacgaattattcgaaattatgaataatattcctaaaaagtacggaatttcagaataacaagcttgatatatatcaaattgaaacctatttgcgatatttttacaataaaatgttacaaatactattgacgcatattataaaaccccttatatttgcatcgagtttttttcatagtattttagatctaaggttaacaagtctttgcaaggggggaatcgtgagattgtttcattgaggagcaaaaaaagccgcatccatattgggactagcggcttttttgtttttccggactctatatcctaaatcaagaaacttatcgtatctttgtcaataggtcacattaaatacttggtactatgaaccagactatttatcccatcggtatacagaacttcgagaagattcgatcaaggattatgattctcgctttggtatctataaactaggatttcccaatttagaggtagaagaaggctttgtcaaatacctgcttcctttctacaccagtgttagcgcccctaagactcctttcgaaatcaggcgttttgtccgggaggtggaataaaaaagcctatgttttcgcacacacgctatacattattcgaaataaacccttacatttgcgaaaaacataatactataccaccatgagtaagaaagtcataactttcggagagatcatgcttaggctggctactccggactatttacgcttttgccaagccaatcagttcaacgctacttttggcggaggggaagcgaatgtcgccgcctcactcgccaactatggcatagagactgagtttgtaacccgtttacccaaaaatgacatcgcccgtgcctgcgttatggaattacgcaaacagggtatcggaacttccaagatcatttacggaggggaacggttaggcatttattttctggagaccggagcggtcgctcgtgccagcaaggtggtatatgatcgggttcattcttccatcgccgagatccaaccggggatgatcgattgggacgaggtattcaaggatgcctcttggtttcactggacaggtatcacgccagccatatccgaaggtgccgccaacgtatgcttggaagcgatacaggcggcaaaccgattgggcatcacggtatcctgcgacctcaactaccggaaaaatctctggaaatacggtaagacagcccatgaggtcatgccggaactagtagccggatgcgatatcatcctaggaaacgaggaagatgccgagaaagtcttcggtatcaagcccgaaggtttcgacgccgccgccacggaaggcgaggtacacgccgcttctttccagtcggtatgtacccaattaatggctcacttcccacgtgcccggaaagttatcatcacgctaagaggctccatcaatgccaatcataacacatggggcggagtgctatacgccgacaaccggttgtacgaatcccgccggtatgacatcacccatatcgtagatcgtgtaggtggaggcgattcttttatgggaggtcttatttacggtttgctctcctaccccggtgacgaccagaaagccttggacttcgcagtagcggcttcctgcctgaaacacacgatctacggagacttcaaccaagtaaccgtagaggaagtagaaaaactcatgtccggcgacacctccggccgtgtctcccgctaattttcaattctcaattttcaatttttaattcccaatatggctcgattcaataaaatacaaacattacaggctatcatccaaaccggaatggtgcccgtctattataataaagaggtagagatcgcaaaacaagttgtaaaagcctgttacgagggaggcgtcagagccttcgagtttactaaccggggagatttcgcccacgaggtatttggcgagctggtaaaatacgccgccaaggaatgtccggaattagtattgggcgtaggttctatcgtagacccggccacagccgccttattcatacagctaggggcaaacttcgtagtcggtccgctgtttaacccggagatagcgaagatatgtaaccgtcgcctcatcccttatacgcccggctgcggttccgtatccgagatcggctttgcccaagaaacaggttgcgacctttgcaagatattccccgccggaaatgtaggaggtccctcatttgtcaagaacataaaggcgcccatgccatggaccctaatcatggctaccggtgccgtggagccgacagaggagaatctatccgcttggttcaaggccggcgtgacctgcgtaggaatggggtccaaactcttccccaaagaagcgatagcgggaaacgattggcaatccattaccgatttatgccgcaacgccttatctatcattcaaaagtatcgtcaagtatgaaaagctttttagatcaagatttcttgctccagaccgacacggcccgtgagttatatcacgagtatgcggcgaagatgcccatcattgattaccattgccatctggatccccggcaaatagcggagaatcaccaattcgaggatcttacggagatatggctgggcggagaccattacaaatggcgggcgatgagagcgaatggtattcccgaggaatatatcaccggagataagccctcttacgagaaattccttaaatgggccgagacgatgccttacacgatgcgaaatccgctttatcattggacgcatctggagcttagccgtatattcggaatccataaagtcttgaatccggcttccgccaaggaaatctacacaacttgtacggataaactacgtacccccgagtatcgtgcgcaagccatcatgaaacggatgaacgtagagatcgtttgtacgaccgacgatcctatagattccttgaaataccatcaaaaaatacgttcaaacggatgccacactcgtgtatatccggcatggcgaccggacaaggtactcgctatcgataatatcaaggcgctaaatgactatttgtccaagctggaggccgccgccgataagaccatcctcacctacaagcatttattggaggctttacaaaaacgacatgatttcttcgccgcccaagggtgccggttatcggaccacgggttggatactttctatgccgaaccttataccgagcaggagattgaggtgatcttcctcaaggctcgtatgggtaaatcgctcacggagcaggaagttcgcaaataccgttcggcattgctatacgaattggcggtgatggatgcccggagtggatgggtacaacaattccatatcggcgcaaatcggaataataacaaacggatgttcaagttattaggagcagacacaggtttcgacgctatcgatgatcagccggtagctgtttccatgaaccgctttttcagccgtttagatcaagaagggctgttagcgaaaacgatcgtttacaacctgaatccccgcgacactgagttgatggtagccaatgcctacaatttcaacgacggcagtgtacccgggaagatgcaatatggagcggcttggtggttcctcgatcagatcaaaggcatggaagatcaattaaatgcgctttccagcctcgggcttttaagccgtttcgtcggtatgctgacagattcccgtagcttcctgtcatatccccgtcatgagtatttccgccggatcctttgtaatatgctaggcaatgagatagagaaaggcttattgcccgcctccgagttttccttcattggacagatggtggaggacatcagttacaacaacgctaaacgatactttgatttctgattactgcaacccgcattgcaatgttactgcacgcctgtcgcagtaacactgcacgtgcgttgcagtaaggctgcaacagctttgcaacattttattcacaaacacttcataagaccttccactatactcgcacatattacgcctacttttgcggcagatttagataaacactaaaatacgcaaacatgaaacaacggctttatgatttcatccctgtcaagcatctatgcgtagggatgtctttatgtggcatagtggcaggtacccaaaccgctcaagcttctcccgtctttgggcaatcatcgggcttagaacttccgagtcccagcatctaccaacaaagtacgaaacagatttccggtatcgtcaaagaccaggcggggattcctgtaattggcgcgaacgtgatcgtaaaagggacgacaaacggagtaatcaccgggctcgatggagatttcctactggaagttccggaaaacgctatcttagagatcagttatatcggttatatgacgcaaagtatcccgataaacgggaaaacgaccttcaacatcatcctagaagaagatacgcagaaattggatgaggtagtcgtactcggttatggagcggggcaacgcaaacaagatctctccgcttccgtgggcgtgctgaacaacacggaagacttggtggcccgtccggttacctctaccgaaagtatgttgcaagggcagttagcgggtgttaccgtacaagcgaacggtggagacccaacggctacaccctcaatcgtgatccgtggacagggctcacagaatggcgataacgtattatgggttgttgacggtgttcccggcgcacccatcgcctctatgaatgatatcgagacgattgtcgtcttaaaagatgctgcctctgccgctatctatggagcgcaatccggagccggcggtgttatcttggtaaccaccaagaaggcgaaagagggcaagacctcgttgagctatgatgcgactttcggtgttcgtaaagctagcaacgtaatcgagccgttaaatgcggaagagcaactcgagatgcgaaaactgtcttacgcaaacgcggggcttacattgccgaccggttgggatttgaccaagaacccatgggtaggtaccacacgtaccaactggatggacgagatcttccgcaccgctttctaccaacgccataacgtagccttgaatgttggttccgagaatgcctccaaccgtgtttcatttgcttacgataacgatgaaggtgtattgatcaatactttcaacaagaacctttcacttcgttacaacggtaaattcaaattgaataaatgggtgaccatcaccgaagacgtggtttggaaaaacaacgaaagccgttcaaaagataccgacagtggttatacgggagttgtcgcggcggctatgtatatgcctgccagcgctacggtttacaatccgctggatggtacttacggtggaacaacgaccgaagacccggattacatcgccaaatatggctccaacttcgcggatatccacggagacgctgtcaatccggttcgcttgctggaagcggaaaaccgctatgaccgaaccagtgacatctggagtacgaccagtctggaactagcgaatatcgttaccggcttaaagttcacgagccgtttcacttacaacctgaagaataatctatataagaacttcagtccgatccgtgacgaggtgggaaaaccctccttgacaaataatctggatgaaacgacttaccgtgcagacgcatggaaaacggaaaacacattgacttacgacaatacgtttaatgacatgcacaccgtgggtgtcttactatccactacggccgatcattacagcaagcgagggctagaggttaatggaaaagatttatctgacgaatccgattatttacaatatctatcctatgcgaattccgtttccgctaccgattatttgaccggtcctgacgcaaacgtatccttgatcgcccgtctggcttattccttcaacgatcgttacttcgttacagcctcttggcgtcgtgattacgcaggccgtctacctaaagataataactatggcgacttccctgccgtaacagccggatggaaaatctctaatgaatctttcttcccgaaaagcgagacactgaatttattgaagatccgtgcttcttggggacgtgtcggtaatctaggatctatcggttacaattacaaatcagctttattaggtaagaattattggtcggagcaggcacagtacggcgtagaatcgaacaagatttggggaaacttcgtctataactctaccgcattaaatcccaacttaacatgggaaacttccgagcaatgggacttaggcctagatgtgaacatgttcgacaatcgcttgagcatggcattcgactatttcgacaaacgcacgttcaacttgatccagtcgcaaacgatgaactggccgggaacgatcggtatcgatgccatgttagtcaatcaaggtgaagtccgcaaccgaggtttcgaggcacaaatcaattggaaccaacaagtaaataaagattggtcgtacttcgtttccggaaacttctcttatctaaagaactgggtttctgatattggggtaaagaacgcagacggaaccccgggcgtttggacaggtatcaccaaaaatgatgcatatttcgatggaagttatcgtaaccttccatatatgtatcaaacagccgaaggagaaccgctggcctctttctatctgatcaagactgacggcatttttcaaagcgatgcggatgcagccgcttatgtaaacaaagacggaaaacgaatccaaccggacgctgtagccggcgatttgaaattcgtcgatgccaatggtgatggagtcatcaatgatgaagaccgtcaatactgcggtagcgctacacctaaaactacattctcattctccggaggattcacttggaagaagctttccgtaagcgctatgttccaaggcgtaggtggagcacaagctttatatgtaggtaaatatatggccttaagcgatgtagaaggaaacttcaaccgctcaaaagagatcatgaacgcttggagtccgtcgaatacagggtcgaatattccacgcttatcgaaaaacgacccgaatagcaactttagcacaccgtctgattggtatctggagaatgcttcttacttacgtttgaagaacttcaccgtatcctatgacttgagtgatgttatcaggaaatgcgctcacctgcaagaacgcaacagcatgatgtctgtttaccttagcggtgagaaccttttcacgatcacgaactactcaggaatggacccggaaaccggcggttgggatgccttgaagtatccggtttcacgcgtattctctgtcggagtcaaattgacatactaatcgggtgttttaaaagatattcatattaacaaaggatcaaaatgaaaagatatattacagtattggcattatccgcattggtttgtagttcttgtagcgacttcctcgacgttcagccggaaggaaacgcaactacaacctcctatttcttgaatgatcaacaggccattgatgccattgacggattatatgaaagattccatcaagagggttgttacggccgtgagttattctgggaacagggagccgcatgcgacattgtttggggacgtacacgcggttataactctttggcgaccttagcctataccggtgatgaatctcctctaagagatgtattcagccgtatgtattctactatgtcccgtgcgaattggatcatccaagaattagtgaagaaagaaaagggaacgacgctgaccgccgtcgagaaacgcagcttgggcgaagcttacttcagtcgcggctgggcacattatctgatcgcttatcggtacggtacggataaacaaggagtgcctttcgtacgttacgaggacttccccgacgattacgacaactccataccgcctcagcaagctaccgttatggacaattataaactgatcatcgaagatatggacaaggcaatcgcctaccttccaaacttcgaatcctatgacgccgacaaccggggccgggcacatcaggctgctgccgtggcgttcaaagcgaaaacttatgcttactgggctacttgggatgctacccaatggaacaacgtcatcgagatggtcaatcaattggagaacaactacaatcgagatctagctcctacattcgcggaactattctcgtctgacttgaaagattattggaacgccgaatatctctggactattccgagtatcggcggcgcactaccgggcggtaccgaattcccgggcattatccttgagaacaaaggatggggcaaatataatggttgggggcagatgaagccctcttacgacatctacgaagaaatggcgaaagatggtaaaggtaatgaccgtttagtacgctcaatcttggaatacaaccaagagttcccgttcttcggcgagacacgcaagttctggtctacctccgaccttgaagctggtttcatgatcaataaatacatggacgcgttcaaatactcagaccctgtaggtgaaggagccgtgagtgctaacggagactggcctacggtccgtgtcaatttcccgatcatccgtttcgcagaaatgttattgttccgtgccgaggcatatttaatgacaggccaagccgataaagcaaccgcagatatcaaccgtatccgcctacgctcaaacttgacaccgcttaccggtaccgccacgatgaaggatctatatcacgaacgccgttgtgaattagcttttgagtttacagaccatctattcgacttaaagcgttggaaccgttcttccaataccgacataaagacattggccgataaagagttgaacgcacatccacgtatccgcagatatgaagaccgggcgaatccggaatccgcgttcacgattattggttacgaagattacaccaacaaaaacgcctatcaagcgcatatgatggtattcccgtatccaagtgaagagattactaaatcgaatggtcaattgaagcagaacgagggatattaaccgactcctttaaaccgatcaaggtacgaataagattcattacgggctgtctcagaaaatgaaacagcccatgttattttctaccgggtaaaaacgcatatctcaaataggtagcttacctttgcctattgtatactatatattaaacaaaaaatataccatgagattaattcaaacgctttcttcttgcttgtgtacaggaataatagccttattcacggcctgtagccaagctccacaatcccccatcgattccgtggatccgtttatcggcacgggatttcacggacacacgtatcccggggccacggctccttacggagcggtccaactaagcccggacacccggaaagggaattgggacgcttgttccggttatcattacagcgattctaccttaatgggtttttcccatacccatttaagcggtacgggatgtatcgacctaggcgatatcctattccgcccgtctctccagacacctctagcgttctcgcactcggacgagaaggcttccccgggctactactcggtgaatctcaaggaggcaggtgtattagcggaacttaccacgaccccgcatgtcgggatacaccgatatacctataaaaaagagacagaggctacgttggtggtcgatatggaccatttattggataacgaatatatgtacgagggctgggtgaagcgaaccggggataacgagcttaccggtatgcggcgtacccggggctgggtagacaatcaatatgtcttctttgtagcgcagttctcgcaacccttctcttccatggaacagccttccgaacggcaagccgtacttaccttcgatacgactaccggaaaacccatcgtctgcaaagtcggggtatcgatcgtaaatgaggagaacgcccgtctgaaccttgagcaagagacggattcctatggctttgatttcgatgccatccatcaagcgacacgctccgattgggaaaaagagctggacgttatcacggtagaaggaggcaccgaagccgagcgcacgactttctatacggcgctataccatagcaagatcatcccgaatatagcgagcgacgtgaacggacaataccgccgtcacgacatgagcgtagcgacgatcccggcaggtcgccgccaattctccaccttctccacttgggacacctttcgggcctggcatccgatgatgactctgttggatactaccttggtgaatgatatggtacagtctctcttggatatgtacgacgccagcggcgagcttccgttatggcccttatcggcgggcgagaccgggaccatgatcggttatcactccacatcgattatagcggacgcttatttaaaaggtattcgcggatatgacgcggaacacgctctcgaagcgatgaagatctcagcggagaagaataagaaaggagcggattattatataaaggaaggcttcatcccgacgaatatcaagaaagaatcggtttcctgcctattggaatttgcctacgatgattggtgtatcgcacaaatggcgaaagctttaggacatatggatgattatgagaccttcatcaagcgctcccagaattttatcaacgtattcgacggtagtacccggttcttccggggcaaacggcaggatgggaattgggagactcctttcgatccattcgccatcggacgttcctatacggaggctacggcctggcaatatcgtttctttaccccgcatgacgtatatggattgacccagttgtccggaggccgggaggcgttcatcgctgatctggatagcttatttatggttacctccgaggtagtcggcgatctggtagacgttaccggattggtcggtcaatacgcgcatggcaacgagcctagccatcacatggcttacctatatagctatgtgggccagccctggaagacacaggaatggacccgtcgcttgctggacgagatgtaccagcccacgccggaaggcatcatcggcaatgaggattgcggccagatgtccgcttggtatatcttgagcagcctcggcttctactccgtatgtccgggtagcaaccagtttatcctaacgaccccgttgttcgataaggcgaacatgaagctgggcaatggcaagacattggtcattaccgccaaccagccggataagaacaagtatatcacgaaggttaccttaaacggcgaggagatatcgcattgctacatcacctacgaccagttgatgcaaggaggcacactggactttacgctctcggcaacaccggacaagcgttggggaaccgctcccgagtacgctccctattcctatacggagcaacctaccgtctctatcccttacatagcgaatgatctggatttgtttgaaggtgagattacggcggaactaaaatccacgacacccgaggcggttatccattacacgcttgacggatcggaaccggatgagaacgctccggtatacagcgagccattcgtcttaaaagagaccacgatcatcaaggccaaaggatataaaaagggattcgtacccagccgtacgtactcgatccaagcgacaaaagccgtattacgccccgcattatccatacagcctacgaagcatggggtagcttatacttattacgaaggagagttccaatgggtagccgatctgcaaaaggcgaaggtggtcgagaccggaacaatacctgagccttccatcctgaacgctaaattgccggatcatttcggttatatcttcaccggatatatatacgccccagaagatggagtctatgagttcagtacccgctcggatgacggtagcgtcctctatatcggcaaagaaaaggtagtggacaatgatgcctcccacgccgccatcgacgcgacgggacgcatccccttacaaaaaggctaccaccccttcgccttgcattatttcgaggattacgagggtgagtacctaggctggagctggcgtacgccaagcatgtccaaactagacgcgatcccaacagagaacctttatataaattgataatattaaatactgaatcatatgagaagaacaactctatccgtgctatccgccttagccatcctgctatccggcatgatcgttccggaggccgcggcacaaagtcgccgagacaaagaacaaacgtatgtactagagaaaccttacgaggtcaagaaactagtcccccctaccggaaagaaaataaagaacgtgatcctcatgatcggcgacggcatgagccttatgcacatgtactccgcttggaccgccaaccggggtaagctctggctggacaactcccaatacaccggcctctcgaaaacctattgcgccaaccgcctcatcaccgactccggagccggaggtaccgcactggccaccggccataaaacgaactaccatatggtaggcgtagatccggaaggcaagcctttggaatctttggctaccttggcgaataagaaaggcctgtcaagcggcatcgccgttacctgtcgcctatgggacgctacgcccgccgacttctgctgccacaatacggatcgcgacgccgaggccgagatcgtagcggattacgtgaactgtggcgtcgattacgtattcggcggcggctccaagctattcgagaaccgtgcagacggacgtgatttgttcaaggaattaagggagaaaggttaccagactccccgtagctgggaggaactggcgaagattcaaaaaggcaaggtattctgcgttaccgataccgtagacaccccgcttcccgccgagcgaggcgatctcttggctcgtgcctcaatgaaagcgatcgatctgctgggacaaaacccggaaggtttcttcctgatggtagagggctcccaattggatgattacggacatttcaacgatatcgacctgttgatgcaagagacacatgatttcgaccgtacgatcggacgtatcttcgaatgggccgcccaagacggtgagacattggtcgtcgtaaccgccgatcacgagaccggtggccttaccttggtggacggggatctgaacgagggccgtatcgtttgtaaattctccaccggagggcatagcggcgtaatggtccccgtttatgctttcggcccgggcgccgagaacttcacgggtatcttcgagaatacggatatcttctggaagatcaaaaagctcctgaatctataatcaaacagtattcatccgatggagagtataacagggctatcccgctagtcaagtaccgcagtactttggctgagaggacagcagtacttgactagcagtactacggtacccgaccgggaggactgtgttcaccgactgaggcgcgccttctccctctctcccccaataaatatcataaagaatgacaacaagacgaaacttcttaaagcaatcccttcttgcggcaggcgcggcctccgttcccgccgggaaccttttagcgcaagagaaaatggaagagaaacgccccaaatacaatcttccttacaagaacacctacctgaaggaacccttcgtgaccgagaacgagttccggacggcgaaaccggagaccatcacgcccggaaccttcgaggaggccaagcaaatcctcccggacccgacttggagcggacacgagaaggaaattgagatgtactggaaggcttggcaaatcggcatcggcaacatcaaggccccggaaccggattccggtttcgtatgcagttacctcgatgtcgcctacaacggcaatatcttcatgtgggactccgccttcatgatgatgttcgcccgtttcggtacccgcttcttccccttccaacgtacgttagataatttctacgccaaacaacatccggacggtttcatctgccgggagatcaaggcggacggagcggactgtttcgagcgttacgatccgaccagcaccggaccgaatatcctcccttggagcgagatcgtctattataagcagttcggcgatatagaccgcctacacaagatattccccgccctttgcgcttattataaatggttgaagctaaaccatacgtggcgcaacggtacgtattggaccagcggttggggtaccggcatggacaacatgccccgggtggaaccgaaatacaatccgatatacagccacggccatatgatctggctggacgtttgcttgcaacaatacttcaccgccgggcatctgcttgagatgggtttctatctggagcgttggcaggagatcgaggagttcgaggacgagcagaagatgctaaagaagtatatcaacgagaacctatgggacgagaaggagcatttccttttcgatcaatacgccgacggaagcctttcctccaccaagggaatctatgcgtactgggccttattgaccgatgtcctgtccaaggaacgcatggatgctttcgtggccgagctggataacaaggagacattcaaccgcctgcaccgcgtcccttcccttgccgccaaccatcctaaatacaaggataacggccgctactggcagggtggcgtatggccgggagcgaactatatggtgattaccggcctattgcaacaaggctatcgtaaattggcttacgagatcgcacgcaaccattacgataacgtcctaaaggtgtataagaataccggtacgttctgggaatactacgctccggaacatgaggagccgggcttcatggctcgcccgaatttcgtgggctggggcggactggcaccgatctccggcttgatcgagcaaatcttcggcatccgctccaatgtgtacgagaagaaattgaccgtagacgtgaacttgacggaggcttatggtatcgaccgttatcctttcggcctcgacggtctggtagcgatcaaagtcaagtcccgttcttccgctacccaagagccgcaggtagaaattaccagcgacgtccccttggaactaaccgtcctttggggcgacaaacagaagacggctaacgtaaaacccggcacgcaaaccgtataaaacagtaaatccatcaaacatccagttgtagagacggggcacgccccgtctctacaactagactcaaaaaacaattagtatatgaaacagattctatccttatttatcacctccctcgccctctgtacggcttgctcctccccgaagggatcggacacagttcaagtggcggagacaaccacggagcagacgattcagaaagcctcctccgcaattcattacaacgccttctcgcacaatgattactggcgggagagacctctgctggacgccttgtccttccgcttcaactgcgtggaggccgatctgtggctgatcgatgacgagctatacgtttcccatgaccgcccggaacccaatccggccattaccttcgagaacctatacctcaagccgctcgtggcccgcatacaagcgaatggaggtaaggtctatcccgatagcgatcgtcctttctacctgatggtggattgcaaggcacaaggcgaagagatgtacaagctattaaagaaacagatggaaccttacaaggaatatttctgttccgtcgataacggcgaatataaagaaggtgccgtcctcttcttcctttccggcgaccgtccgaagaacagcctgccgaaagagaacagccgcttcaccttcctcgacggacaaataaaggatctgggacagggcatccctgcttccctcgctccggtcataagcgataattactccgatttcttcacatggaaaggcgaaggtgagatgcccgccgaccaactacagaagatgcgtgagatcatccggaaagtccacgatgagggaaaactattccgttggtggggcgccccggataccgagcagttcaaacgcttcttcatcaaagaaggcgtagacttggtaggtgccgatgacctgaatgggttatacaacgtattgaacgagcgttaaacgagaaaattacaataggcattataaggttgttacaatgggcattctagcatctttacaacaggcatcgtaacagccttataatgcccatcatagttttaacatatcacaaccgcttttattccaaccaaggctgcggattcagcttcgtcttttccttccacaattggaaatggaggatcgtggaattaccgtcctccggatccgaatagatccttccgatcgcttgacgggtagagacccggtcgcccgcttttacatatacctgactcaaattgctataaaccgtcaagtagttaccatgacgaacgattacggaattattataccccggcaccacgaacacacgcgtcacctccccattgaataccgcacgggcatccgctccgggtgaggtctggatatcgataccactattactggtacgaacatatttcaactcctgatgctgttgctcgccgaatgtagagacgatcgtatgtcttccggccaccggatacggcaaacgtccccggttattggcgaagttatcggacaattgcttctccgcctttgtcatcgcatagccccctttcgtatccgccacacgttcctcacggatcggctcgtttttactctccggtacgggtttacccttagcggcagcttgttcacgggcacgacgctcacgttccgcacgttcacgggcggctttcgcctcggcctcggcacgggcgatctcctcggcgatctgcttctctatctgtcggtttaaagcctcggcttgacgacgcttcttttggagatccgccttcaaatccttttgtctcttattcaatagctggacttcctctttctgagaagcttcctcgctttctagcttcttactctcttcttgacgagttcctaaaagggcacgtttctcggcacgggtcttctccatctcagcttgcttacggctgatctcggcctgcttttcaacgatgtcattcgcttgccgcttctgccaatccgcatattcccgcaaataccgcatacgccgcatggattgagagaaactctcggcggataggataaacaacaatttatcttgcgagctatggcgtttataaagccctcgcatcgatttaccgtaattcgtctgcttatcgcccagttcccgttttaaggtgcgcaactggccttggatattcaagatatctttctcgatctcatccagctcttgattcaataaactgatgactttcttacgggaaagaatttgtttggagagtagattcaaacggttcagggaagttttagcagtctgggccgtctcttgcaataatttattcgtctcctcgatatcggccaacgcctccttgcgctgctgctccaactgacggacagcggcggatttctgaccgtaaaccacggtagataaagacaatgccaatagaacgatccagacgtgcctcatgatagattattgattcagattcgtaatcgttttcaatacttgcgcaaaggtaatacgcttatatttagaaggaaccgaaaaatccaacttgagcggctcgtccagttggatacgggagtaatggatcttcaccccaccctcgggattcccgttcttcaacacctgcacatccatcaacatcgggaacggctgccgatccaccaagcgaaaatcctcgtacagccattgcaaggcataacgatcggaaggatccgctacataggtagagagaagtttctcctcgccatccgccttaaaggtatagaaaagccccatggcatccttggtcttgatctcggctaccgggccttcttgattcagcttaaaacgattataatgcttacgggaaacgccctgctcccccgggataaacagatgattcgtgaaaagagcctgcaaattgtagaagttgaactcgatcggagtctgcccttgcaaattggaataattctcgatcatatagcgtttattcatgcggtctaccaccttgatcgtatcccggctcaactcgatacggaagatctcgatcccgagaaaaggttgtaccgacagttggaaagcactatccttgaccatcttcatatccacccgagagctcatttgcttaccagggatatccagatccacgttcaaccgggccgtcaaggtacggaactggaaggattgatcctccaccgactggaagaactcattatgagccttcacgctagcggattccaccgtcccgactttcttggacgatttacagcctgtcaacatcgaaagtaaaagacctccacataacaggaaggtcaagaaatagtctcttttcatttcgcgttctcgtcttctatatattgttgctcggcgatcttacggttcaatatctcggaatccttccccatctctttcgcctttttccattgctccaccgctttttccttatcaccgttcatgaaaaggatgtccccataatgatccacgagttcggcgctctttgtcttatctttctccaaagcgctctcgatatagattttcgccaaggtatagtttccttgtacgaagaagatccaagcgtaggtatccagatacgtggcgttgtccggttccagcttgatacattgggcgctcatacgttccgcctttttcaagtctttcttctccaaagaaaggaagtaactgtagttgttcagtacgaccacgttcttgtcattatacttcaacgcctcatcgtacgctttatacgcttgatccaattgccccatctggtaataaatatcaccgatctgaccgtagaaatccgatttcagcggcaggttctccttcggaatgatattcaagcccgcataataggtattcaaggcttcttgatatttctgttgttggtagtaagcgatacccagatagaagtaatattccggcgactcggggaaaagctccatacaagccgtacagatacggatgacctccgggatatcctcccctttcaaagccagattcagcaattgctgccaagccccggcgttactcggttccatctcggttaccaactggaactggaatttcgcctcctctgtctttccttgggccatcaagagaccgccatacatcagctttaagtcaatatcctccggatgttgctccaaaagagtttggaataaatggtttgcgttctcggttccctgcttcgtttgttgcagtttcaagatataccgggaaaggatgttcactttcgtctccacgtccagcttctcgtttaccaaagcgctacggatttgttgctcggcggcctccttatcccctttcgcctcgtagtaattggccatagagacgatataataagggtcagtcggatcaatctcattcgctttttgatagcaagccaaagccttgtccatctccccgttttccaaatgaagatcgcccaatacgatctggtaacgggcctccataggatatttagccgctagcttctcgatctccttgaaagcctcttccggtttctccaactggacgtacagtttgtatttctgcatggagatcgcctcgttcatacccataaccgactccaacgcgtcataagcctcgatcgccttcccgatctcgccggcttgcgtcaaggcatcggccagataataattcagctcctccttctccggataatcacgaaccaattcctcgtactcctcggcggcttcgccatacatacccagattccgggtgatagacgccaatgccattttatacgtgaaattatccttgctgttggctacggctcttttcaacatctcgaccgctttctccggacggttcagctgcacataaaaagaagaaagctcatacaagactggagccgccgtcgagtcaatcgccaaacaatggttgaaggcatcataagcggcgtcgaattccccggcgttcttcaagttcaagccctcataaaagaagtaatcgaatttacgttgatccttctccgtttctgtagcaccagccgggagcacagcgaccaacgagaggaaagagatgagatatatcagttgcttaaacatcctattattcttgttaaccttattattcttattcttttccggtatgaccgaatcccccggctccccgctccgtatcatccaacgtctccacgagttcccaatccacatggctatgagcggctataaccatttggcagatacgctcaccatcattcaccgtaaaaggctcggaagatagattcacgagaatgataccgatctccccccggtaatcggcatcgatcgtacccggcgtattcagcagggttatcccatgctttaaagccagcccgctacgaggacgcatctgggcctcatagccttccggcagcgagatataaagtccggtcgggattaatttacgttccaacggtttcaacacaaccgattccgacaaattcgcccggatatccatcccggcagataaaggagtcgcataacccggcagcgggtgatgcgatttattgataattcttactttcatatattatcttattttctttattcccgaacggagactattcggattacaccgagtgctccaaaacgaagcgataaagaccatatcatcatctatataataaataaccttataattcttatgaacaaccaaactgcgatactctcgttcaagccctctcaaagcaggttcaatcttacctaaacgagggaaaacagacagccgctcatttgttctctgcacttcgtccacaaaacgaatcacggccttttccccaaaagcaagaaaaccaaacgatatcgcttccttaaacaacaccttagcctcatcaagccaaactacttgcataagaacggatattcatttcttagctcttgaaagactttctcgctcggggtaaaacgtccagcgacacgatcctcttcagccctccctagactttctttcaattgagcgatcgaatgaggtaatgccggtacatctccaaacaaactatcagaaacctcttgtctttcttgaaactttacttttacttttcttacagcatcaagaatcgcttccataagctcctcattacctaaggcactcatggtttcctctatatatacatatttcaattcatttactgtcatacttcttaataggttctaatccttgatctccacaaaggtaatgaattaactaattaacccaatccccgttctcttttattaactgaactaaacgttctacagcgtcttcctcggggatattcttgaggacacattccttacctttatacaggctgatttgtccacgtccggcacccacataaccatagtcggcatcggccatctcgccggggccgtttacgatacagcccatgataccgatcttcaagccttttaaatgggaagtagcctccttgatacgggcgatcgttgtttgcaggtcgtacaaggtacgtccgcaactcggacaagagatatattccgtcttactgatacgggttcttgtagcctgcaagatcccgaacatacagcgatccgagacaaccgcctcgcatccctcattgtgcagcatcaagccatccccaaaaccatccagcaaaagcgtaccgaaatcggcggcggatttcagttgcaacaactccacatccgtctcccggaaatcacgatgcaagacaaccggcacgtcacaacccgccatcagcaatttatgcatagccgcacgttgcgagccaaccccattccgatgatgtgtacttaataaaaccaccacggtcttatccgctttcaagatctccaacatacgatccgtaagatccatatacgtcagacggataaacttaagcggacaatcgtaatcctttaactcctccgcttccgaggcgatgaagcaaggaaaagcattcggacgctctttccaaaaatgagcgtctaccaataaacggaaattatccggcaaattatccggatcttcctttcctatatatatatagtccggcaaggacaaatgatcaaactcaaaatccccgttactacgatcggagatcacgactggcgggaaagtacctccgataccctccaccacacggcttatacgacggcatgtcgccaccgtatcgaaaccgggagccatcgaagcctcgataggacgatgattttcccgttccctaatataatccaccaatttacgcgctaccggcatttccgcctcggggtcctcactcaaggaaacccggatcgtatcaccgataccgtcacatagaagcgtaccgattccgacagcgctcttgatacgcccgtcctcaccgtcacccgcctccgttaccccaaggtgcaaggggtaatgcatattctcggcctccatcgtacgaaccaacaaccgcacggtccttaccatgacaacggtattggaagccttaatcgaaataaccacatccgggaaattctcctcccggcaaatgcgaagaaactccatacaactcgctaccatcccctcgggcgtatcaccataacggctcatgatacgatcggagagcgagccatgattcacaccgatacgaatagcggtgccatgtgccttacaaatattcaagaaagggacgaaccgctcacggatcttctcgatctcggcggcatattcctcatccgtatattcaagatggctgaatgtctttaccttatctacatagtttcccggattgatacgtaccttttccacctcaccggcggcggcatcagccgctctaggattaaaatggatatcagcgaccaaaggagtcgtatacccttgttcattcaattgtttacgaatctcgcccaagtttcgggcttcccgttccccctgtgccgtaaaacgcacatactcagctcccgcctcgatcatacggatcgcttgagctaccgccgcctccgtatccatcgttgatacattagccatggattgaatacggataggattctcacctcccatgggtgtgtcaccgatttgggcaacggatgatttacggcggttgtaattaaagtaagccattgttaattgaaaattgagaattgaaaattgagaatgagtgttgagaactgaaaacctaaagagagactttctccttaattttcaattctcaactttcaactttcaattaattagttttgtatttaaaagaaaccttagccaactcctcgttagccttcacgattttcttcttcaaatcctccttataagcggatagcttctcctgaagttgctcgtcgccgacggcaagcatctgcaccgcaaggataccagcgttcaaagcgccattgatgccgacagtagccacagggattcccggaggcatctgtacgatagccaacaaggcatccataccgtccagcgtagagttaataggcacgccgatcacgggaaccgtcgtcatggaagcgatcacaccgcaaagatgagcggccattccggcagcggcgatgataaccttgattccacgtcctttagctcctttggcgaaagcctccacctcagcgggagtacggtgtgcggatagagcatgcatctcgaacgggatctccatctcatccaagaacttagccgccttctccataacgggtagatccgaggtactacccatgataatacttacaacaggtgtcattcttatttagcgattaatttttgatagtcttcagcggataatagttcctccaactcagaagcgtccgtaagagaaatcttgattaaccaacctttaccataagcgtcttcattaaccaattcaggagcgtcttccaattcagcgtttacttccaaaacctctccgctaaccggcatgaaaagatcggaaacagtcttaacagcttcaatcgtaccgaacacctcttctttagcgacggtctccccctctgtcgtaatgtctacataaacgatctcacctagctcgccttgagcgtaatcagtaataccaacataagctacgtcaccttctacacgaatccactcatggtcttttgtgtactttaaatctgcaggaaaattcataattttagtgtttttattagatgaataaatagatataactcattaatgaggctacaaaggtacatataaatcccagacaaaaccccgcatatacctgcattggtgtatgcctttttaaaaagatacgcgaggtacctaataaaccagccacgatcaacacgactataaaagcccagtagggatttatcatatggatacgcgccactcccataacaccgcccagtaacccgccgataccaatggcatgcgcgctaatcttccaagcaaaattgatgcataaggcgattaccaaggctacgcaagccccgatcagcatcgctaacaaccaaaacggcatcagcatcttatacaggaaaaagatacataccaagatggaagtgataaaaatcagataaggaaccacccgctccttccggtcggaaagctctatatcgccggccgcgccatttttcaccaataagaagatgaaaagcccgggaactatcgctgtcgaaataaaggtacctccggcaatcagcagcttcacaggtaacgggtaaatggcgagaaatgtaaacatcaacgccaacacgatcccataggtcaccataagcaacggatggaacacgaaggatattatattcgagaatagtttcatacgcttttatatttcttttctcagacgagctaccggaatccccagttgctccctgtatttcgctaccgtacgccgggcgatgacataccctttttctttcaggatcgtagccaactcctcatcggtcaacggttttcgtttatcttcggcatctacatgttctttcatgatctttttcacctcacgggtcgagatctcctcaccggtatcggtctgcatagactcggagaaaaagtatttcaatggataaataccgaaattcgtttgcacatatttactgttacttacccgggaaatagtggagatatcatatcccgcacgctccgctacgtctttcaagatcatgggatggagggtagcctcatcgcctgtcaggaaaaagtcccgttgtaaatagataatcgcctccatggtacgctgcaaggtctcattacgttgcttgatagcgtcgatgaaccactgggcggaatccaacttttgtttcacgaactgtacggcatcccgcctctcagcggtttggttcgccttattcgccgtataatcctgaaacatctcggcatactcccggttgatacgcatatccggtaccccccggttattcatgctcaagataagctctccattatgcgcttccaccacgaaatccgggatgatctggctcatcgccacttccatagaaccaccccaactacttccgggtttcggatttaacatagtaatctcgtgaatgaccttctttaacgtttcctcatcgatatcgagacctcgtaagatcttatcgtaatgtttgcgggtgaactcctcgaaatattcggtcaaaacacgaatcgccaaatttgtaaccggagtattctccttcttatccagctggatcaacagacattctttcaagtcacgggcacctaccccggcaggctcaaaatcttggatgatattcaagatagactcgatctccttctcatctacctcttgtccggcttggaagatcaaatcgtccgctatcgccgaaaggtcccgtctcaaataaccgtcatcatcgatatttccaatgatatactccgctattttcatttgcttatccggtaaatcccttaacccgagctgctgtaacagaaactcattcaaggattggcttacggagaaggggacatcctctttccgttccgcacgctcggtcatttcccgtagcttataatcaggtatatcgtcttccgttaaataatctcccaaagaaaggtcggtctcagtatcaacagaagggatctcttctcccccctcctcgctttcagttcgttcaaaatcatcaacaggctcttttccttcctccaaggctgggttatcttccagctcatgcttcacacgttcttccaactcgatcgcgggaagctccagaagccgtatcaactgtatctgctgaggggatagcttttgctgtaacttttgttgtaactgttgctttaacataatctaaatcattgcactgtaagggcaggacaatcacccgccctcttatttatcaacatgcaaatataagtttttagttttaacagtacagctattaaactataatagttctaaacaaggtgcatgatggaccctagcgactttaaaatccttccttcacgatccatttgatcgagaggaagaatcgttcgatcaagcgtaattcttccgttacgatctccgcggaggcttgcgtctcgggcgagacaggcaggtcatgaaacttaggttgttgtcccgtataccggtatctaccaagctctgcgtgaggaaaggcaggatgagttgcagtacgctggctgtcaccatgcccagcacgagctgtgccatctcccgcctgtagggcgatatatatcggaaaggcgaaagccagctgagttacagtcagccccatttggccactctggtaactgcccccttgttcttaattgcagtgcaaaggtacgatttattttgaaacctgcaagcgtttaggcagaaaaatttaccatttttattgcggtaaccgctgcctcgtcccctttattgccatatctacctcccgcacgatcctcggattgctgcatggtgtcggtagttaacaggccgaaaatgaaagggatatcgtacattaaattcaattctgtaataccttgagtaacgccggaacaaacgtaatcaaaatgtggcgtgtcgcctcttacgacgcatcccagaacgatcactgcgtctaattctttagtctcggccaatcttttggctccaaaagtcagttcaaaacttcccggaactcgtttaactacgatgttttccggtttcaccccgtgcttttcaagcgtgttgcaagcaccttccaataacttctcggtaatgttcttgttccattccgcaactacgatgccgatgttcatctctgaagcatcgggtacgctgttgaaatcgtactcggataaattctgataagctgtagccatacttgtctctttaaaagaagaggatgccttgtttgaccgagacatcctctgttatactatataatatactgtttatttattttcctgccgaagcacgggtgatatacttatcgatatcggatgcctccatggaagtgtaatacttgtccttgatagtcgtgtaagcctttacagccttgtcgtactctttcaagttctcgtaagcgataccggccttcttcaagtaaatcgggctgattacctcattgtcggcctccttagcggctttctcgaaatagctgatgccttctttcgtattacccatgttcacgtagcaatcaccgatcaagcctgtaaccgccggagataccatttggtcctttccgctgaaagatttcaataaatcgatcgctttctgcgtatcgcccatcttgtagtagcagatacctgcgtaagctttcgccaagtttccggcgtccgtgcttccatattggtcgatgatagcctcgaaaccttcatagtcagctccattgccgtttaaagccaaggcgaaagaatctctggcgaagtattgctcacccttgaacatggcggcggcagcttttttctcctgaggaactaaataaccatgcttgattcccaaaacagctccaacaacgagtgcgacagctattataccgtaaataatcttctttgaattgttttcaatgaattgctccgatttggagacaatctcttctacttctaactccttgttggtgtccttttctttagtagccataatgtgttatagttatttattaattttatcgctgattttaagccataccatacggttggcgattcaaagcgcaaaagtagttttttttgctgatataatctatacttagaagtatattttttaattttgtacgattaatacggtttagatgatactaaagaagctttctgttctcaattacaaaaatatacttcagtccgaggttattttctcgcccaagatgaattgctttttcggcaataacgggatggggaagacgaatctattggatgccattcattatctctcgttttgcaagagtcatgtcaatacgcctgatagccagataataaacagtgatcaagatctttgcgtggtgcagggtaactatgattatgagggacgtgaggaggagattttctgtgccatgcggcgtaggcaacgcaaacagttcaaacggaataagaaggagtacgacaagctgtccgagcatatcggcctattaccgttggtcatggtctctccggctgatgccgacttgatccggggggggagcgatgagcgacgccgttttttggacttaatcatctcgcagcaggacaagccttatctgcatgcgcttatccaatataataaagcgttgctccaacggaatacgttgctgaaagatcagagcatggatgcctctctttatgaggtattggagatgcagctgggtatgtacggccaaatcgtttacgagaagcggaaaaaactggtggaggattttaccccgatctttaatgagtactaccagacgatctgcggctctgccgaggaggtagggctacattatatctcgcaattggaggaaacggagcttgccggtaaattggcgatgagccgggaacgggatcgtatattgggctatacctcttccggtatccataaggatgagctggaaatgacgttgggcgggtacctgattcgccgggttggttcgcaaggacagaataagacgtatctgatcgccttgaaactcgctcagttcgctttcctaaataaacggggacggactacacctatcttgctgttggatgatattttcgataagctggacgctagccgtgtggagcagatcatcaaactggtcagcgagaatggcttcgggcagatttttattacggatacgaaccggaagtatctggatgagatcttattggctatgaatcatgactatgccctcttccgtgtggaacgtggcgaggtacaacctatggaggaataaggatgcagagaagaaatacacagacattgggtgaggtgcttcgtgactttttcgaggataataccgagttgtacgagaaaatgatggagatccgggtccaacgtgcgtggggagaagttttagggcctacgatcatgcagtacacacgtaatatatatgtacgtgataaggtgcttcatgtctcattgacttcctccgtacttcgtagcgagttgacgctttgccgggaacggttggtgaaaagcttgaatgattatgcgggtgcctcggtcattaccaatatcgtttttcattgagtgtggctttaccattcgcaatattacttactgggtcaagtaacatatactgcccagccccggtaagtatatatggcttgacccagtaagtatatattctgcggagagatcaatagatggtgtcttctgttattacgtaatccattttcttgtcgagtggctctaccgggacttgcggtatcatctggaacccgaagcatatgccaaccttgggagcgttgagcgtggaaagaaggcggtcgtagaatccccttcctcgtcccatgcggttcttgtctttatcaaaggcgactccgggcacgataatcaagtcgatctcattctttggaacttctatgccgtccgccttgggctctaatatcccgaaaggtccgggttttagggattccggcccttcgtaaagaagcaatctcaaatcatcaccgacgatcaagggcaacagaagctttttcttccggtaccatttctcgataaagccggcggtctgtacttctcccggtatggcgtgataaagggcgatacaagaagctgcttggaacagttccgtctgttccaagcggtccatgatcttatccgatagctcgcacaaggtaatcctcgaatattctttctttcgagaggccatatcttttcgtagggcctgcttggctgtgtaagtctccattcgctgattgttttaatagttccgcattcggcacggattttccctcttgcaagatcttgatcgcacgtaataaggtaacgtcatcttttaggaaaatggggtagaagcccgcctcgtcgaagaaattccttacgatatacgcttgcaattggttctcgattaacttgccggatatattaattaatgtgggacgtctcttgatgcccttggtagcagcgaagttcacgaaatcggaaaggagcggttgttgctgcaagtaattatataattcctcccaagtcttgaatgagcctagtttctcccgatggcggtctgagtactcgagcgcatacaggtaaagcacgccgctatttaccacatttgagtagtaagaggtaacgccactcgtatcacgagggataaagatatctggcatgataccgcccccgccgtatacggtacgtccgcctacggtctggtattttaaggaatcatccatcttgatgctatcggccgagtcaaactcgccgtgcatatatcggttatagatatcttggtcgtaagcgtccgtattacccatctcatatttcttctggatgcagcgaccggacggcgtgtaataacgggcgatggtcaatcgcatctctgaaccgtcgctcaatgacatttgagtttgtaccagacctttgccatacgttcttcgtccgataatcgtaccccggtcgttatcttggatcgctccggagaatatctcactggcggaagccgagatctcatcggtcaatactacgatcggggcgtctttacaagttccggttccgttcgcgtatacgtcggaacgggggaacgacttaccttccgtgtagacgatcaagcgtccttccggcataaactcgttaatcatattgatagcggcatccatatacccgccggtattaccccgtaagtcgatcacgaaagaggtacagcccgcttgttttaacttggcgatcgccgtgatgaactcattataagtattccgggcaaatttgctaaccttgatgtaacctatacctttagccgcctcataagaaacatcgaccgaattaactgggacatctccacgggttacgtcaaaatagagcaactcaggagaattccctcgctgtacgcctagtttcaccgtactgttctttgcgccccgaagtgtcttcatgatctctccttggttctttttctttccggaaaaaatagaatcattgatcgagatgatccggtcgaagggcagtaaacctgctttctctgcgggaccgccgctaattacgctaatcactaggatcgtatcggtttgcatattaaatgatacgccaataccactgaaagaaccttccagctcctcattcaccacggaagcgtcttccgcggggatatatacggagtgagggtctaattcactgaatattttcgggatcgtactctctaccaacttagacatgctaaccgtgtcaacatattgctcgtcgataatgtccaagatggcatttatcttgttgccgctggagtaggaccgtttttttccttgactgatagataaataatggttcccaataaagatacctaaagcgatactagctgcgatgataaccgggagccatacggtcagtcttttgtttttatccataaaaacgttttatttattcgttcaaatctatataatctactatgataccggcacgcttcaataattcgcagccgtccgctatgcgataattctcggaatagaccactcgcttgatcccggattgtatgattaatttcgcgcattcaatgcaaggggaggaggtcacataaatggtcgctcctttactgctgttcgatgaggctgccacttttgtgatggcgttagcctccgcatgtagaacataaggcttggtgacattattctcgtcttcgcaaacattttcaaaaccggcgggtgttccattgtatccgtcggatatgatcattttatcttttactaataatgcgcccacttggcgtcgtttacagtacgaattctcggcccagatagcggccattcgcaggtaacgtttatctaattcgtgctgtttttctgttttctcgcacatttgtttactcttttgtcttttaatccagacacaaaggtagtgattatttagatttaccgggcttatcgcccggtaaattattacttcttaataccattacggattaataaggcgtctatcgtaggctcttgtccacggaaacgcttgtataacacggcaggatcttctgttccacctttggataagatattgtcacggaaagatttcgcgacctccttgttgaagattcctttcgatttgaaaacggagaaagcgtcggcgtctaatacctcggcccatttatatccgtaatagccagccgcgtatcctccggagaagatatgtccgaagcttgtgcccatcaaggcttccggtacttccggcatgattacggtcggagcccaagcttttttctcgaatgccgctacgtcaccgtcgaaaggttgctccaacgtatgccatgccatatccagcaagccaaagcttaattggcggcagcaaaggtagccagcgttgaagtttgaggcgtttaccaagctttgtatcatctcttgcgggattttctctccggtcaggtaatgaacggcgatctgatctatgaactctttttcagtcaaccagttctccatgatcagggaaggtaattctacgaaatcacgataaacgctggttcccgaaaggctggaatatgttccttgcgctagcatgccgtgcaaggagtgcccgaactcatgcaagagtgtgttcacctcgtcgaaacttaacaaagagggcttcgtgtctgtcggacgggtaaagttcatcacgataacgatctgaggacggctatcttttccgtctttatctttgtattgagccttgatattgttcatccaagcgccggattgttttccgtcacgagggaagaaatccgtataaaggatagcaaggaacttaccatcggcatcgtatacttcgtaagcgtctacttccggatgataaaccgggattttcttgttttccttaaaggtgataccgtagagctgggtagctaatccgaatacgcctttctttacgttgctcaactcgaaataagggcgagtcatctcgtcgtttaccttgaagcggatatcccgtaacttctcggaataataactccagtcccaaggcataacggtgatattctctttctctgtacctaacgcaaatccttctaccgcattgtattcgttgatcgctatcggtttataagcttcgagtaactgattcaataatttgtatacgttcgctgagtttttagccattgtgtgttccagcgcatattcggcgtaattcttgaatcccatcaactgggcgatctctaggcggatattaacgatctttttgataatgtccttattgtcgaactcatcccctttatttcctacgctcatgtattcacgatacattttctctcgcaaatcacgcttgtcggaataacgcatgaatggaatgtaactcggagccgagagattgaataaccatccgtctttatctttacttttggctaacatggccgctgcgtcacgagcactttcgggtaaaccggatagttcgttctcgtccgttattagtaattcgaaccggtttttatctttcaaggcgttttgatcgaactgcaaggttaacatgcttaggtccatacttagcttgcggtatttttccttgtcatctttatttaacgtagccccattcgctttaaacgactcgtaaaggtcttccagcaatttggcatcctcggtagaaaggttcaattgttcttttttatcatagattgatttgacccgagcaagtagcttctcatttaagaagatgttattggatgtctgggataacttcggggagacacgttgcgagatttccatcatctcgtcgttagcctctgcccctaatacattaaaaaaaacagaagagactgtttccaataatttgccgctacgttccagagctactaccgtattctcgaaagtagccggttgcgggttattggcgatctcttgcacctctttttccatttgcttgattccttcgtcgaaagcgggctcataatgctcgatcttgatcttatcgaaaggaggggtctcgaatggtgttttaaacttcccgaagaaagggttatttgctgcgtgtgtcatttgaattgcgcttaataaaattactacattatataataacttcctcatattaaaaattgtttgtaaatttccgcaaaggtaggcattttaatcacaggaacattataggcatctgtttttatattcagattgatttaaaatgaaaaatagaacatttcctatgactaaaccgaggcttgttttcggggggctgtaccttgattttgagctttgatgaatatgataataggattgatttaacaaaaatttatatgtttgaaaacactcctttagagcacctttctttttaaagtcttgatctataagtttatcgtagaagaaggatgcctttttttctaaataaatataaaagacagtttgtttttttagttattaaataatacttttgattctcagaaacgaaaataatttcattttgatattaaagaaagtaacttaaaacccaaatacacatatgagttatcttaaatttgacaaaacagtaatgataaacctggaagagtcgctgactcgtgaggtgcttcgaaccaaccgtttgggagcctatcactgcactactgttgttgattgtaataccaggaaataccacggactactcgttatgcctgtgcctgcgattgatgatgacaaccatgtgttactgtcttcttttgatgagacggtaattcaacatggtgccgaatttaatcttgggttgcataaatatgcaggcgataatttcagccccaagggacataagtacatccgcgagtatagctcagagacagtacctcgtacgctttaccgcgtaggaggtgtgatcttctcgaaagagaaagtgttttccatgtacgagaatcgtatcatgattaagtacacgttggaagatgctcattccgctacgaccttacgtttccgtcctttcctcgctttccgtagcgtgaagaacttaacgcaagccaatggtaacgtgaaccaatcttacgaggaagtcacaaacggaatcaagacatgtatgtatcccggttatccggaactgtatatgcaatttaacaagaaagttaaatttgtgtatgagccgtattggtacaatggcatcgagtatccgaaagaacaagagaggggatatccttatcaggaggatttgtatgttcccggatatttcgaggtccctatcaaaaaaggtgagactattattttcagcgctggcgatagtgcagtggcaactacccgcttgaaggcactgtatgagaatgaggtcgtagctcgtacgcctcgtactagcttcttcaattgcttgaagaattccgctcagcaattttattttcgtcccaaggaagacgacgcttatctattagcgggctatccatggtttaaagtacgtgcgagagatttgttcgtagctcttccgggtagtacgttgtctatcgatgatccggttcgttttgagaagatcatgcatacggcgatgccggcgatgcgggcgtatatggagaatgggcgtttcgatgcggtgattcgtgagatcgagcatccggatgtctttttatgggcgatctgggcgatccaacagtatgctaaacatgagggcgttgaaaaggcacgtgagctatacggcgatttcgtgaaagaagttatcgattatatacgggaccagaaacatcccgatatgaaattgatggagaatggtttacttttcgctaatggaaaagataaggcgattacttggatgaattctaccgtaaacggaaaacctgtcgtaactcgttccggttatatagtggaatttaacgctctttggtataatgctctttgtttctatacggaattgatggggggagtacctgtcgagggtattgatccgattatcaagtcgatggataaatcgttcccggaaacctttgtgaacgggtataattatttgttcgattccgtgaatggttctacggtagattggagcgtacggcctaatatgattttcgctgtggcattgccttattccccattgacgaggatgcagaaacgtgccgtggtggatatcgtgacgaaagagttgcttaccccgaagggtttgcgttccttgagtccgaagagcgaaggatatcgcccgtattatgtagggccgcaatatgaacgtgatttggcttatcaccaaggtactgcttggccgtggttgttaggcgcctatttagaagcttatttgcgtgtatttggaaagagtggcgttgcttttgctgaacgtatgttgataagcttagaggaggagatgtcattgcattgtataggaacgatcccggaattgtttgatggtaacccgccgtttaccggacgtggagctgtctcatttgcgatgaacgttgctgctatcctccgtgttgtggatttgttgaagaagtataacgccgaataaaactaagtaccattatgaaagcattaatgtttggatgggaatttcctcctcatatcttgggcggtttaggaacggccagtttcggtttgacacgaggcatggcaatgcagcccgatatggatattactttttgtataccgaagccctggggcgatgaagaccagagctttctaaagatagtgggtgtcaaccaagttccgattgtttggaaggatgttgaccgtgaatatgtgcagcaacgggtttccaaagcgggaatgaacgctgaccagtattataagtacagggatcatatttatgcggatttcagttatcgtcatgtgactgatttagggtgccttgagttctccggacgttatccggataacttgctggaagagattaataactattcgatcgtggcaggcgtgatcgctcgtacggaagagtatgatatcatccatgcgcacgactggttaacttatccggcgggtattcacgctaaaaatgtgagtggtaagcctttggtcatccatgttcatgctacggattacgatcgtagtcgtggtaatgtgaatccggatgtctatgcgattgagaagaatggtatggacaatgcagaccatatcataacggtgagtaatttgactcgtcagacggtgattgagaaatatcatcaagatccctctaaggtaacgaccgtacataacgccgtagagcctttaagtcctgagattttagcgatcccagataaaaagggtgtaaaggataaggttattacattcttaggtcgtatcacgatgcagaaagggccggaatatttcgttgaggctgccgccaaggttttggctaaggctccttatgcacgtttcgtgatggctggtagtggtgatatgatggatcaaatgattcgtttggccgcagcacgtaatatttcagatcgtttccactttaccggatttatgaagggcaagcaggtctatgaggtgttgaaagccagtgacgtatatgtgatgccttcggtttctgagccttttggtatctctccgttggaagccatgcaatgtggtgtaccctctatcatttctaaacaatccggttgcgccgagatcttggattatgcgattaaggtggattattgggatattgaggcgttagcggatgccatgtattctattattacttatcctgccatgcatgagttcttgaaagtggaaggtaagaaagaggtggataatatcaaatgggaatatgccggacaaaaggttcgtcgtatttacgacaatgtgataggtaacaaataaattaacgacaagacaaaaataaaacaaacaatattatgaaaacgatctgcttttattttcaaatacatcagccgttccgtttaaaaagatatcgcttcttcgatataggtaacgaccattactattacgatgatttccagaatgaggagattatccatcgtatagctgaacagtgttacttgccggctaaccggactattttggagatgattaagaccagtggtggtaagtttaaggtagcgttctctatttccggcgtagcgttggagcagatggagatttatactccggaagtgatcgatagctttaaggaattggcggctacggggaatgtggaattcttgtctgagacttatgctcattctctttcttccttgggagatccggaggagttcaagcatcaagtaaagaaacaagaagataagatcaagactttattcggggttaaaccgaaagtgttccgtaatacggagttgatttactcggatgatatttccgctatggtttctgagatgggctataagggaatgttgacggagggtgctaagcatatcttaggttggaagagtccgaactatatgtattcttcttgcgtagctccgaagttgagcttattattgaagaatgaccgtttcagcgaggatttatcgaaccgtttcagtgattatagttggaatgaatatcctttgacagccgataagtatatgtcatggattgctgctactccggattcagagcaaatcattaatttgtttatgaattatgaggtgctgggatctttgcatccagcttcaaccggtatttttgagttcttcaaggctttgcctcgttttgccgcggataaggggattagtttctctactccatcggaagtatttacattgatcaagccggtagactctatctccgttccttatccgatctcttgggtagatgaggagagagattgtagttcttggttaggaaatgtattgcagcaggaagcgttccgtaagattaacgagatcggtgaacgtgttcgtttgtctcagactcgtcgtatccgtcaggactggtactatctgcagagcagtgaccatttctattatatgagtacaaagcatatgggacagggaggctttagcccttacgataatccgtatgacgcatttaataactatatgaatgttctttccgatttcattgttcgtgtgaatgcggaattcccggagaatatagagaatgaggaattgaattcattgctttctacgattaagaatcaaggagaggaaatcgagagtctacagaaagaattagataaattaaaaaagaaggcggcgaagaaataagtcgttaattgatttgactagactatttttggagagtgacgggtccttttagggacccgttattttttgccttagagatacggatataaaaaaagcgagatgaaaaacatctcgcttttttattatatagattctttgctatctgacatatttacatgatgtaataccaattttcatcacctcttcatcctttcgtatctttactcctgaaggagctagataattcgtgatggctgttgtaacaactgtactttgaccgtaactgttgcttgtggtagttgttcgttgaacagggataagaagtaggctcaaatctttgtccggattattctccatctgatattttaataaattggcaagattcgggaatgagtacgtacgagtagtcgcatcgtaagcattggatagaaacgaggttacattattgtcaatctgactaccctcaaagaaactttttaccgaatcctctggcaatattaatagataaggaggaggagccaatgcatattgccaatcttcttgcggcatcgcttttaactcgagtggtaaattattcacgatacgctctttcatgatcggagtgatttcctttgtcggaagaacaatgcgtgtacaaacgccggcaggagtcttaaagaatgcatagctgtcgttcggttgtagcaattgactcatatccgtatttttgaaacgacttagctgaatgacctctttagtgacggagaaagcttcccacgtggttattaaagagtcttttcctgctgtgcttttaaccgcataattataatatatcttaaggacagagctagccacggacaatatattaccactaccgaaggtagttgttacataaagccccgggaaaaactcattgaaagtttcttgattcttgaatgtacccggattattaatcgtttcatcataaaatttttgtccgaactcagtaggcattttaatgcttacaagagggctgtaaccatcagagtttctaagggagtcggatatacttgtgttataagctgtataagcttgagcacccattgactcttgcatattgcaatattgcttagggtcaatatttgtataaaaattcttttgtaacggacttgtaattttaaagatctccgcacgcataggcgccaaggagtctcctacccatacaccgtttttattggaaccattataatatatattgaattccaccgaatcaatttttccctcataaggtgtatgcgcaaattgaaaatcactcggacaatagaattggcacatataatccgatacaaggttaccatacagcggatcgtagagttcacccaactgggcgctagtagaccttgcgtaaatagaatctaattgcaccgtagtggcttgtatctggaacgtgtccatatataccgcaattgtatcgtcgcctggctgaatacttgttcctatcgaactaaaatcatcattacacccggccaaaatgctagcaccaaggccaagtccaagtattaaaagcttgattttcattactacatttattatttcgtgttagaatccaataccacgtcgtagaacttattgaactcgtccatataagtttccggtgactgatagggaaggaaaggagtatctttcttggcagagatataatcaaggacttcttgattgatcgtctcgctaccttggattacaccatcagcgaaatcaatcgctaatttggttaggcccacaaaacttgtatctgccttgattaacttcaagtcagcttctttggctccgtccgccttcagttttgtcgcgaaatctttgtttagcgggttcttgaagtcatcgttgtagatcgaataaacgattttcgcgttacgcaggcacgggtcatcggcatacattcttttgatgtaaagagccgttaacgctgacatccagccatggcaatggattacatcaggaatccaacgcaatttttttacggtttccaatactccgcgtacatagaagatcgaacgatcgtcattatcttcatactcatttccattctcatcgctgaccgtggatttccgttggaagaaatcctcgttgtcaataaagtaaacctgcatccgggccgattgaatggatgctaccttaatgatcagaggatggtccgtgtcgtcaataataagattcataccagacagacggataacctcgtgcaactgattgcggcgctcgttgatatttccgaattttggcatgaatgtcctgatttcgcgaccacgctcctgaattccttgcggcaaatttctacatattgtcgcaatctcggattcgggaaggtagggagtgatttcttgggctataaacaagattttttttgcatccattctgtaaactagttttataaagacgctacaaagatacgaaaaatcttttatttacggtaattatttagttgctttgcaccgtcaattaagcatctatctgatgaaaatagtaaatagtattaaagatttgaaggcttatcttgctgaggcaaagcaggataataagaaaattggctttgttcctaccatgggagcactgcataatggacatcttagcttggtacaacattgcgtgaaaaacaatgatgtatgtgtagtcagtgtttttgtaaatccaacccaatttaatgacaaacacgacttggaaacgtatccccgtacgttggaggctgattgtgtgttattagaatctgccggctgtgactatgtattcgctccctctgtagaagagatgtatccggagccagatacccgtacgtttgatttgggaacggtatctgaggtaatggaaggcgctaagcgtccggggcattttaacggtgtagcgcaggtggtaagtaaattgttctatatcgtggagccggataacgcttatttcggagaaaaggacttccagcagatcgctgtgatccgggcgatggtgaaacaattgaatatccctgtaacgatcaatgcttgtccgatcgttcgtgaaggcgatggcttggccttgagtagccggaatacccgtttgacaccggaacaacgtcaaaaagctccgttaattgctcgtacgttaaaagaaagtactacctttgtgcccggaaaaagcgtacaagaagtgattgactatgttgtcaatacgattaatagcgatcctgtcatggaagttgagtactacgagatcgtagatggcaatacgttagagtctatcaagaactggtcggataccgattatccggtaggttgcatcacggtatattgcggagaggtacgtttgatcgacaatatcaaatactaattataagtcatacatgtttatagaggtagtaaagtcaaaaattcaccgggtaacggtaacggaagctaacttaaactatatcggtagcatcactatcgacgaggatttgttggacgccgctaatttgatcgcgaacgagaaggtctcgatcgtgaataataataacggagaacgttttgagacgtatattatcaagggcgaacgtggctcgggagtggtttgcttgaacggagcggctgcccgtaaggctcaacccggagatattattatcgttatgtcgtatgccatgatggatttcgaggaggcgaaaacattcaagccttccgtggtatttcccgatacggcgacaaataagttgatatagcagacgctaggctttgtagagatctctaatcataagaaaagctcgtcgggatgcggcgggctttttttatcttcataaatttaagtaatgagcgagttatgtacacgaacaggaatatatggaatgttagctacccgatctttttgagcttgttggcgcaaaacgtgataaacgtgactgatacggcttttctaggtagggttggtgaagtcgagttgggggcttccgctatgggaggactttattatatctgcgcttttacgatcgccttcggttttagtacgggatctcaaatcgtgattggccgtagaaacggagagggacgttatgaccagatagggcctgtcatgatacaaggcgttttcttcctattgtcgctggctgctatattgttcttgttttctcgttttttcgcgggagatgtgatgcgtgtattgatttcttcggacgctatcttgaatgccacggaggaatttttggattggcgtgtgtttggcttcttcttctctttcgtgaacgtgatgttccgggctctttttattggtattacccgtacaaaggtgttgacattgaacgctgtcttgatggcaatgacgaatgtcttactggattatcttttgattttcggacatgccggattcccaaagatgggcattcaaggggcggctatcgcttccgtcatagccgaggcggtatcgattctctttttcgtggtttacacgagacttaccgtagatatacgtaaatatgcgcttaaccagattcgttctttcgattttggcttgttgaaacgggtgctggatatttccgtgttcacgatgctgcaatatttcttgtctatcgctacttggtttatgttctttatcgctgtggagcatttggggcaacgggagttggcggtggcgaatatcgtacgtagtatttacgtcgtgatgttgattcccgttaattccttagcgaccacgacaaacacgttcgtgagtaatagtatcggggcgggagcgatcaatcaagttatgccgactatcaggaagatctgtaagttatcgttgggcattatggtcgtgtttgccgctattgtcagtttgatgccgggatgggtcgtgtctgtttatacgaatgacgcttcattagtggcggcctcggttccatccgtttacgtgattgtcggttctttattgatcggatcggtagctaatgtggcgttcaacggggtgtcgggtacgggaaatacacgttctgcgctttttatggaagcggcggtattgattctgtatgtgctttttgtatatgtcgcggggatgcgtttgcgtttgccggtagccgtatgcttcttgacagaggctatttactatagtggattgctcgtcgctagcgtaatctatttaaagaaagcctcttggcaaaataagagaatataagtatatgaggggaaaaaaacacgtacgtcttttttcgaaaacacgtacgtgaattctgaaaaacatgtacgtgtttttttgaactgtgaatattgggaaattgttcgtatttttgtattgtaatcaaataagaaaggtaactcatgtccacgaagcaatgtgaagatatgttggtaggaaaaggagtacggcctactgccgcacggatccttgtcttgcaaaaattatcagaacgaaccagcccggcttccctgttcgaattggaggcggagttggagacgttggataaatcgaccatttcccgttcattggccttgttattggaacatcatgcgatccattctttcgaagatggtagtggctctataaaatatgagatatgccagagccgttcggagacatgcccagtgggtgataggcatattcattttttctgcgaggtatgccgtaaaacctcttgtttgaataatatcaagatcccggtcgctcaattgccggaaggatatataatggataccattaattatacggtaaagggtgtttgcccattgtgtaataagcgacgttctcagaaaccctgataatttgcaatcaagttgcaactcccttctcttacctttgtaccgtaatcaagaagtaaataattaaaatagacaagattatgagtacaacatgtggatgcgaacattgccattcgcacggaagttccggtttatggatgccgacggtttctttcgttttgttggttataggacttatcgggaagtacttggggataagttggtttgctgagtcttggatagaggccatttggtttctggtcgcttttttgccggtaggacttcctgttatgcgagaagcttgggaagcggctttgcagaaagacttttttagtgagttctcgttaatggcgatcgcctcgatcggggcgttttgtattggggagtatcccgaggccgtagccgtgatgcttttctatacggtaggagagaggctgcaacttcgagccgtgaataaagcctcgaagaatatcagtgacttattagatgtccggccggaacgaacggatgtatggcggacgggtagatatatgaatgtatttccgaaggatgtgaaagtaggcgagcggatcgaggtgaagcccggtggacgtgtgcctttggatggcgttttattggaagccgaggcacagttcgatacctcggcattaaccggggaaagtatgcctcgttctatccgtgagggtgaggaggtgcttgccggaatgatcgtgcaggggcaggcggtacgtatacaagtgaatcggccgtacgagcaaagtgccttggcccgtattttggctttggtgaaagatgcctcggagcggaaagcgccggcggaattgtttattcggcgtttcgcacggatttataccccaatcgtgattcttctgtcgtttctaatcgtgtcggttcctgctttggtagggatggtgacgccttctttccagtatgttttctcggattggttatataggggattggttttcttggttatttcttgtccttgtgccttggttataagtgttccgctcgggtatttcggtggtataggcgccgcttctcgtgccgggatattatttaagggcggtaattatttagatgcgatcacacgggtaaatacggtagcgttcgataagaccggtacattgactaccgggcgttttgaggtcacaacggtggaaagcacggagatcccggtttctgatcttttgagtattttgttatcagtagagcggaaaagtacccatccggtagcgcaggctgtagttcgctatgcggaaaaacaagatagcgtgccgatggaaatcactgacatgcgggaattggcagggcatggtgtcgaggctatcgtgaacggtcggcaggtgcttgtcggtaacatccgtttattggccgaacgtgatattcctgtcccgaaggaattatccgatagtgtttctaccgtggtggtttgtgcgatcgatgggaaatatgcggggcatcttctcctttcggataccttgaagaaggatgccgtggatgcgattcgtcggttaaaggatctggatgttaaagatatttgcttgttgtccggggataagcaagagatcgtgaatcaattcgctgagcgtttgggtgtcgataaagcgtatggtaatctgctgccggaggataaagccgcttatatagagcgattaacggcggagccggataagtcggttgcctttgtgggcgatgggatgaacgatgcgccggtactggctttaagtgatgtcggtattgcgatgggtggattgggatcggatgcggccatcgagagcgcggacgtggttatccaaacggaccagccctctaaagtagcggaagctatttctatcggacgtgctacccggaatatcgtccgtcagaatatcgtgggatctattggcgtgaaggtgatagtccttgtggcgggagccttcggttttgccacgctttgggaagctgttttcgcggatgtaggcgtatctttgctggcggttcttaattcgatccgtatactaaaacgttgagaagtgaagaatttcgagatcgctttcatcgcatactcatctctttttcgtacctttgccccttaatccagtagaaaataatataaatacacatacgaattatgtttgagaacttaagcgaaaggttagacagatcgtttaaactgttgaagggcgaaggcaagattaccgagatcaatgtggcggaaacattgaaggatgtgcgtaaagcgttgttggatgccgacgtcaattataaggttgccaagagttttacggatacggtaaaagagaaggctttaggacagaacgtgcttacatcggttaagcctagtcagttgatggttaagattgttcacgatgagttggccagcttgatgggaggtacggcagtcgacgtgaatttgcagggaaatcccgccattatattgatgtccggtttgcaaggttcgggtaagactactttcactggtaaactagcgtctttattaaagaccaagaaaaataagaaaccattattagccgcttgcgacgtgtatcgtccggcagctatcgagcagttgcgtgtagtcggagagcaggtaggtgttccggtatacatggaattggagaataagaatccggtggagatcgctatgaacgctatccgcgaggcacgggctaaaggcaatgacgtcgtgatcgtggataccgccggtcgtttggctatcgatgagcagatgatgaacgagatcgccgctatcaagagcgctatccagccggatgagaccttgttcgtggtagatgccatgacgggtcaggatgccgtgaataccgcgagggaatttaatgagcggctgaacttcgacggcgtcgtacttacgaagttggatggtgatacccgtggtggtgccgctttgtcgatccgtacggttgttgataagccgattaagtttgtcggtacgggcgagaagatggatgccttggatattttccaccctgaacgtatggcggatcgaatcttaggcatgggtgatatcgtgtctttggtggaacgtgcgcaagagcaatatgacgaggaagaagcgaaacgtttgcagaagaagatcgctaagaaccagttcgattttaacgactttatctcccagatccaacagatcaagaagatgggtaacttgaaagagttggcatccatgatcccgggtgtaggaaaggcattgaaagatgtggatatcgatgataacgcgttcaagagtatcgaggctatcatttattcgatgactccggatgagcgcagcaacccggctatcttgaatggctcacgccgtcagcgtatcgctaaaggtagcggtacgagcatccaggaggtgaacaagctgatcaagcaatttgatgagacccgtaagatgatgcgtatgcttacttccgcgaagtcggggaagatgaagctaccttcgatgaagccctcgttcagacgttaattaacaggagacaatcaataatatggaagaacaacattatcaattgctggatggtaaggccgtttccgctcagatgaagaaggagatggctgaggaggtagcccagatcaaggctgccggaggtaagatccctcacttggccgctattttggtgggccatgacggtggtagcgagacttatgtggctagtaaagtcaagacttgtcaggagattggttttaagtctaccttaattcgctttgaggaggatgttacggaggaagaattgcttcgtaaggtcgatgagttaaataatgatccggatgtggatggttttatcgtacagcttccgcttccgaaacatatatccgagcagaaggtgatcgaggcgatcgattatcgtaaagacgtggacggtttccatccgattaacgtgggacgtatgtctatcggtttaccttgtttcgtatcggctacgcctgccggtatcttggaattattgaaacgttatcatatcgagacgcaaggaaagcattgcgtggttttgggacgcagcaatattgtcggcaagccgatggctaccttgatgatgcagaaatattatccgggcgattgtacggtgaccgtatgccatagccgttctaagaacttgaaggagatgtgcctgtctgctgatattattatcgtggctttaggtgttcctgaattcttgaaaggggatatggtgaaggaaggcgccgtgatcgttgacgtgggaacaacccgtatgccaagcagcgtaaccaagagcggatttaagttaacgggagatgtcttgtttaacgaggtcgctcctaaatgttcctatatcactccggttccgggtggcgtagggcctatgacaatcatttctttgatgcgtaacacattgttagcgggaaagaaagcgatctataagtaagtggatggataaaaaagttcgcaaaaggtttgtgtaatcagaatttatacctatctttgcgccgtcttaaagggggaatcctttgaaaggcggatatggtgagagtagctcagttggttagagcatcggattgtggttccgagggtcgaccaacgaccccgagattacaaatcacgtgctctggccaactgagctaaagaggcgatacttctaaaagcagccgtttcgtcaccacggcgaaacggctgcaaatttagatattatttcttacataccaaatttatctaccgttttttttatttggctctgattttttctttgaatttaaccagttgcttctccaaagcctcaacacaatcgtctatcgccccttcgaaagtatcgtttattttatcagcgaaacattccccgttcttcacggacaacattatactggcctgcttgttcttcaccgtctcaggcttaaccaccttcaatgtaacctctgccaatataataccatcgaagtattgctccaatttagaaactttcttctgaataaacgcctccaactgtgcagttgcgtcgaaatgaattgcttgaattctaacgtccataataacctccttctttttttgctcttggatgagcatgatacactttttttaattcctcaaaggttgtatgcgtgtaaacactggtagacgctaaactgctatgacctaataaatctttcacagcgttcagctcggctccgttgtttaacatactcgttgcaaatgaatgtcgtaacacgtgtggacttcgtttcgccagcatgggtatctccgacaattgcttttttactatattataaacaatccccgtcgacaactgattcccgttctttcgaacgaaaaaccattcaccggctgcctcaacctcacgatcacggacttccgtgtatgcaagcattaagttttttaaaccctccgcaaaaggaatcaaccgctgcttgttccgctttccggttaccttgacctgcatcgcctcataatccacatccacgtttcgtatgccgattaactctgagcggcgcatcccggtatcgtatagcatctcaatgaccaaccgattcctcacaccttcaaaatcctcatcaaatccgtccccgtccaacaacgcctccaactcgctatccttaataaaataaggcaagggtttcttcgttttcggaccgctcaccaatctcaacggattcgcggagacaatgccccgtttcatgagaaacttaaaaaaagatttcaaagaacttaatttccggtttaccgatacgggagagagcttctcgtccatcaaactgacgatccagcttctcacgaaatccgagtcgatttccccggggtcgaatacaccttctcgatgctctcttacatacctctgaaattggtccaaatctttcgaataggcaccaatcgtataattggaatagttccgctcataccggagatagtttagaaagtcatcgatcagcatattctcgttgcatcaacattcatgcaacgaaaataggaataagaattcaataaaacaagcccggaagctataattattcttctacttgttgcaaatgctgtacgtagatagcacgcatagtctgctttctcttcgtaacagacggtttctcgaaagcctgacggcctctcaattccttgactacacctgttttctcgaactttctcttgaatttcttaagcgccttctcgatgttttcgccttcttttaatggaactacgatcataatttaaattgttatattgtttaattatttatatcctcaaattgagcggcaaaattactgattgtttcgggattagcaaaactttcagcgattatttttataaaagatgcctttctccgtaattatagccgtgattagctcgtggggagtaatgtcgaaggcggggttgtagacttttacgtctttcggggccatacgccttgaataccacatctcggtgacctcatcggggttacgttcctctattacaatggaatcgccgtccgggcacgagccatcgatggtggatgtcgggcctaatacatagaaggggatcttgtaatgccgggccaagatagccactccggacgtgccgatcttattcgccacgtcgccattggcggctacacggtcgcaacctacgaccacggcatgcacccagcctttccgcatgacgatagaggccatattatcgcaaatcagcgtcacgtccacgccggccctgcttagctcataggccgtgagccgggcgccttgcaacaaaggacgggtctcgtcggcgaagaccttgaaaccataacctctctcctgccccagataaatcggcgccaaggcggtgccatactccgagaccgccagatgtccggcgttgcaatgcgtaaggattcccatcccgggacggagtagctccagacagttctcgccgatctgccggcaagcggcggcgtcttcctcccggatcgcgatcgcttccttatataatagctctttccattccgggacagacaaggttggatgagcgaccaatacccgctccatccggttcagcgccgccaccagattcaccgctgtcggacgggaaccggccagatactccttgatcttccgaaactcattcacgaaaacggatttctccgccgtatcgatccgacgggcgcagacatagataccataagcggccgctaccccgatagcaggtgctccacgtacctttaatttatagatagcgtcccatatctcctcggcagtggtaagggtcagatacgcttccttacccggcagcagagtttggtccaaaatgatcacaccgtccgcttgctcgttgaaacgcacggtctttaaatcagatagagtttgtatcattcgatatgaatatattaatagttcacgggacccagcgtagcttctatcgccacccctgcggcggtaaccgctatcgcccctacgacaaggcctgccgtagccccatgagtctctttcacgtaaaagaaatcgccggattgctgctgtccctcatcgaaatactggggagccacgtcgccgaccttgatcaatttcgccagatagaagttccgctcaaaagaggaatgcttcaagggcttcccattggtccctccggcgaacaacgtcaggtagctacggaatctcagcggagaatcttcttccgtaaaatccttcactcggatatttacggtggtgtttgctttcgttgtcatttgctcctttacatactcttccttcgggatctcgttaaacgggaagttggctaattgcaaaggcgtattgactaatttggaatgcggcgggataaactcaacgcccttcggcaaactcacatcaccggagaaggaaccttccgagtagctccacccgctgctgctcctatcgctccaatgaaaggagctaccggatgccacgctagagctctcgcctctcaccgaggccactttcggatcgtaggtggtagccacgtcatcgataatcagcgccgaccgcccccaatccacatacaagggttcatccaatttattataaatggtaatagtaaccggggcgttctctccccagaaacgataagagatacgtaccgtatcgttttcctgcacaaaatcacctctctcattcttctccccgacggggtcattcgagttcaacatcgaataataataagaagaacatgcgctcaaaccgagaagcagagccgcaaagacaaaaagataaagcagattcctcatggcacttcttatttgtttctacaaagttagcaaattattccttgatatctattgggtgccttatctttaacttgatttaaagggatcggttcacaaggttgtggaccacaaggctgtgagcccatacacgtttatcataacctttagctcttttatccggaatccttacccttttctcttttatatattgtacctttgaagctgaagtattcatcatctaccatctgttggacaatcatccaacagatggtagatgatcgtccaacagttggtgcatgatcatgcaacggctgttgaaagatgaattcttcttgaagaaaccgctaagctcgcctataaaaacgagtaagcgatctagaaaaatcggacaaaagatctataaccatttaaacacagcacagatgtcagcaaattacaagttagtcagaaatcccaacccgaatccagaggaatccgggaagtcattacccctacatcctcgtttggtctcttgcgggacgatacatacggatgagttcatcagcagagcgaagtcccggtcttctttctctcccgcggatatgaaagggatcttgcagcttttccaagacatgatggtggacttcctcatgttcggttataacgtggagctagaggggatcggtactttcagcgtctcactgaaaagccggcccgtgatggaaaagaatgagatccgggcggaatccatccatttcaaggacgtgaagttcagatcgtccaaggaactaagagaccggctgaagaccatgccggtgtttcgtgacgagtacacggttagcgatcccgcatatccctccgccaaggaatgcgagcaagaggtattccgttatctggagacgaacccttttatccaccagaagaagtatatgtcgctctgcggatgctccagaagtaaggcttccctcgacttgcggcggctggtagaggaagggaaactgcggtgggaaaagctgggtacttcccatctatattataaggtagaagagccggtttccggcgagacaaatccaaaataattcattaactttgcgagtattaatgttgactaaaataaaatgcgatgaaaacaaacattcctgaacgtatcgccgccctacgggaggctatgaggcaacagaaggttgacgcttacatcatacccagttccgacccgcatctaagcgagtatccggccgatcgctggaaatcgagagaatggatatccggcttcaccggctcggcgggaacgatcgtggtcaccgcggacaaggcgggcttatggactgattcccggtatttcctgcaagcggccagccaactggaaggttctggtatcgaactctataagttggcgcttccggagacaccgtctatcacggaattcctcttgcatgagttacacgccggacaggccgtagggctggacgggcaaacctatagcgccgccgaagcgagtgccttggcaaataaactaaaccgtaaagaaatcaagctggatacctcggccgacctgatcgagggtatctggaaggaccgtcccgccgttcccggaaacccgatattcgagatgccggaagcattaagcggagcctccgtgcacgagaaactagacctaatcaataaccagttgcggagcgagggcgccgactgcttgatcctcgccgccttggacgagatcgcatggacattcaatatccggggtacggacgtgacctataacccggtcgtagtcagctacgccttcgtatcggaggatgagagcgtgctattcatcaagccggagaagctgaccgccgagatcaccgagcatttgaagaaagaaggggttacgctggccgaatactccatgatccagaggtatctatcccgcctaccggaaaacagccgggtattcgtggatatgaacaagacgaacgtctccttatacgacgcgatcccgggaagctgtacgatcgtggaagggatctcccccgccaaccacttgaagagcatcaagaacgagaccgagatcaagggcttccaaaacgccgtggtaaaagatggtgtcgccttgacaaaattctatatctggctggagaaacaaatggcggaaggagcccaagttacagagatcagcgccgccgagaagctgaccgccttacgtgcggaacaaccgcaatacatcatggatagcttcggcacgatctgcggctacgccgagcatggagcgatcgttcattactccgctacgccggagacggacgcgaccttgaaaccggaaggattgcttttgatcgattccggcgcacaatatctggacggtacgacggatatcacccgcacgatcgcccttggagagccgacggagcagatgaaaaaggatttcacccgtgtgttgaaaggtacgatcagcttggcgaaaagcaagtttcccgccggaacacgaggttcccagatcgatatccttgcccgtaaagcgctatgggattccggaatcaattacttgcacggaaccggtcacggtatcggccattgcctaaacgtacacgaaggcccccaaagcatccgcatggaggagaacccggtgaccttgaagcccggaatggtgatcagcgacgagccggccatgtatcgtaccggcgaatacggtatccgtacggagaacatgatcttggtacgtgaggacagcgagacggaattcgggaaattcctaggattcgatacgctgacgctttgtttcatcgacacgagcttgattatcatccccatgctctctgtccgtgagcacgcttggctgaacaagtaccaccaaatggtctacgacaagatcagcccgttcttgaacgaggaggagaaagcttggctgaaagagaaaacaacagaaatttaaacaactaaaaatggcattaattaaatccgttcgtggctttaccccgaagatcggtaaagacacttttttagcagacaacgccacgattataggtgacgtagagatcggtgaaggttgcagtatctggtttggcaccgtgcttcgcggcgacgtgaactcgattcgcatcggcaacggcgtaaacgtacaggatggttccgtccttcacaccttatatgagaaatcgacgatcgagatcggcgatgatgtatccatcggccataacgtaacgatccacggggcgaagatttgcaatggcgccttgatcggaatgggctccgtggtattggatcacgccgtagtaggcgagggagcgatcatcgccgcaggttccgtagtattaagcaagacgatcgtcgagccgggcagcatctacgccggagttcccgctaagttcgtcaagaaggtagatcccgagcaagcgaaggagatcaaccaaaagatagccaagaactatcatatgtattcttcttggtataaagaataatagcatgtatttgattatttgaattataaaccatatatttgtatctatgaaaaaagggacaataatatggagttagtaatctttcttggagttgtcgggattatttgcctaataggcttaatttacacgtataccccttcaggcaaaaagtggttacatgaaaaataattcaaataaaggaattcaaaacaataaacactatttgtctcgaagcgtgagatggatagtgtttatttttatagtaggaatcggagggtatctagcgttaccctccaattattatctacgtagggcccttatccatttgttacccaagatcgatcaatatccgattttcgagaaccgggtcgtaaaagcaggttcgccccgcccttgggaactatcggaagcttacaatacgaaaagtattccagagcgttatcttccccggtttgaggagctgggtacggttgcctatgtaatcatccaagacaatcgactgctattcgagcaatattgggaagattattccccggaatcgcatagcaattccttctcgatggcgaaaagcatcgtctcgttagcgatcggctgtgctatcgacgatggatttatccgcaatgtcgatcaaccggtaagcgactttttcccggaattcaagggatacgacggaaaggccctaacgcttcgccatttgctgaccatgagcgccggcgtggatttcgacgaggcttacagctctcctttctctcctaccacccagttgtattatggcgatgacctacaggaaatcgccttcgggatgaaagagatcgacgagcccggcgtaaactttatctaccaaagcggcgtgacacaactgctgggctttatcgtggagaaggctaccggggagaaactcagcgattatgtatcccgcaaactatggactccgatgcacgccgaggaaagcgccctttggagcctcgaccggaaggacggcatggaaaaagcctattgctgtttcaacagtaacgcccgtgatttcgcccgcttcggacaattattactcaacaacggtcaatgggatgaccggcaattgatctctcccgcttatctggcggaagcgacaagccccgatacccgtcttgtctataaggatctcggcaaacccaaccattgttacggattccaatactggattctcgattacaaagggatgaagatcccttatatgagaggaatcttggggcaatacgtcttcacgctcccggaaaagaacgccgtgatcgtaagactcgggcacaaacgcagcgatacttataccgccgatcaacattatccggacgatataaatacatggttggacgcggcgatggacttacttcaataagaatctatttatcaaacgatctaaaaataaacgcacatgagaaaaacgattttaacgacagcgccattggcggcactcctattgctttcttgcgcacagaaacccagtacgcaaaagccagacatcacgtatatgccgcaaccaccgttcaatccgccgacgtatgtttgctacaaggcccccgctcctatcaagatcgacggaaagctttctcccggggaatgggacgcgataccttggaccagcgacttcgtagatatcgaaggcgacaaacgcccagcccctcacttccagacccgggccaagatgacttacgatgataacggaatgtacttcgccgtccttatggaggagccgcacgtatgggcgaccatcacggaacacgacgccgtgatcttccacgacaacgacttcgagatcttcctgaatcctacgaacgacacccataattatctggagtacgaggtgaacgccttgggtacggaatgggacttgttcttaacccgcccctatcgggataatccgcaagtattgaataactgggagtttaccggaatgaaatccgctgtttatgtggacggtacgctgaataacccgaaagacacggataaatcatggagcgtagaggtattcattccttggacttccgtattccaaatggacagaggaaaagaaaagccggaaatcggcgagcagatccgtgtgaacttctctcgtgtggaatggacaacggacctgaaagacggtaaatacgtgaaagtccctatccaaggagaggataagattcgcgagtacaactgggtatgggcgcctaccggggtaatcaatatccatatgcccgaatactggggttatgttcaaatatcggataagattgcgggagaaggtgagactcctttcgtaaaacatccttcggaggagacgaaatggatcttgcgtaatttatattaccgtcagaatgagttcgccgcgaccttcggacattatgccgataacatcaacgacttgaaggcaaacgagctatgcccgcaagagatcgccaatcaactggaaatacatacgacaccttccatgtatgagatatcactacccgcaccagacggtacggtatggaatatccggcaagacggtctggtatggcctaaaaagaaataacacaatttattaatcaactaaaatatcatgaagcaaaagaatttatggatagcggccttggctttaggcatcacgctatcggctcacggacaacaaagtggtggaggcatctcacccacgatgttgcagcaaatcaaacagtcttatcaaggaacgccgaccgataaggcgatccgtaacgcgatcaccaataacgacatcaacaagcttgccgttaatggggagagcaagaacaatttggatacttacttctccaataaggtagagagcaaagggatctccaaccaacgttcctcgggccgttgctggcttttcacgggattgaacgtgttccgtgcgcaggccatcgccaaatatgacatgggagactttcaattctcccagaattattctttcttctgggatcaattggagaaagcgaaccttttcttacagggcatcatcgatactcgtctgaaaccaatggacgacaagatggtggaatggttattcaagaacccgatcggagacggagggcagttcacgggtgtctccgatatcttgaccaaatatggcgtggttcccgccgaagtcatggtagagaccaacagcagcaacagtaccggacgcatgagcaacctgatcggattaaagctgaaagaatacggcttgcaacttcgtgacctgtctacgaccaaaggcacgaccgtagcggatatggagaaaaagaagaccgagatgctaggtacgatttaccgtatgctcgtattgaacttgggagagccgcctacgaaattcacgtggactcgcaaagacgctaaagggaatccggtagagacgaaggaatatacgcctcagtccttcttccaagaatatatcggggacgatttgaaaaacaactatgtcatgttgatgaacgatccgagccgcgattattataagttgtatgagatcgattacgaccgccacgcttacgatggaaagaactggacttacgtaaaccttccgatcgaggatatcaaacaaatggctatcgcttccatcaaggacagtaccatgatgtatttctcttgcgacgtgggcaagttcttcgatcgtgacagaggcattctggatgtaaacttctacgattacggttcactgatgggtacgactttcggcatggataagaaacaacgtatccagacattcgccagcggttcctcacacgccatgaccttgatggctgttgatctcgacgcgaatggaaagccgaagaaatggatggttgagaatagttggggtcccggagcgaacgccggccacctcatcatgacagaccaatggtttaatgagtatatgttccgtctggtagtcaacaagaagtacatcacggatcaagtaaaagagatcttgaaacaaacaccgactcgccttcccgcttgggacccgatgttcgctgaagaggattaaaataaaacacggatgagatagacaacgcgaattgttcaattaccaatccgtacatctatctcatccgtattccattgctatatcaaaagagtctgggcatacaatcactcgaatagcaaacccggctttatctattaacggatatggatttgtcgcaagatttgatccgtcgctcctacactgtttttcacaaaatcaccggcagcttgcccggaggtttccaaggctgtcgggtcggtcaataactcgtccatcttcgttcggaaagaggaatcgtctgtgatggagaaaccaccacctacggcgatcagatccttcgcctccttaaacttatggtatctcgggccgaataagaccggcatcccataaacggcggcttccaacgtgttgtggatacccgctccgaaaccacccccgatataagcgatctgtccatagcgataaatggaagataagagtccgaaactgtcgatgatcaagcaatccttatcggccagatcatcctcatgcgcctccgatagacggacggacggacgttttagcatcgcctcgatagaaaggagatgttcccggtgaatctcatgcggggcgataatcaacttcatctccggatgctcatggaaataagggataaagatcgcctcgtcttgaggccatgaactgccggccaccatcacgatcggcctcttaccttccttgctttccaagaaacgttcgataaacggaagctcacgagcttgcttccggacatccaacacccgatcaaaacgggtatcgccggtcaccgtcacattcgtgatgccgaactcgttcaagagtttcatcgaacgctcgtcctgaacaaaaagatgattaaaataagatagcatcttccggtacggctttccgaaccattggaaaaatagctggtcggggcgaaatatagcggaaatgatataaaccggtattccccgcttccgcaactcacgcaaatagttcccccaaaactcgtacttgataaatatggcgatcgccggattcgccagattcaggaacttcttcacccggaaaggcgtatcaaaaggaaggtagcagatcacgtccgctcccttgtaattcttccgtacctcatagccagatggagaaaagaaagtcagcagcaccttatactccggatgttccgccttgatcttctcgatcataggacgcccttgctcgaactcgcccagcgaggaggcatggaaccagatgtatttagcgttccggtcgatcttctcacgaagtatggaatttgttttccattgcccgaatcgcatcagtctcgcctttttatggaaaggcgagatcaaagcgactacaaaagcgtagagatgtattgctaaactgtacatgattattttaatatctcgatagcccgttggatacggcggatagactcctctttacctaaagcctctgtgatatcaaagatgccggggcctttgccctcgccaaccaaggccagacgggcggcgttcatgatattccccaaatgatatcccttgctctcgatccaagccttgcactcgttctcagtaccttctacgtcgaacggctcacgggcacgcaattgctcgataaactcacccaattgaacagccgaatcttccttccagcgtttcttgcgagtcttctcatcgtactccgtcggggcgataaagaagaaagagcaaagatcccataactcactcacgaaattgacacggcctttcatcatgccgaccactttctctacataagcatgggtagtctggataccatggctttccacgatcggcaagaataggtcagcgatctccgtattactcttctccagcaaatagtggtggttaaaccatctgcctttctcataatcaaacttagcgccgctcttgctgcaacgagacaggtcgaacaaacggatcaaatcatccatgctcatcacctcttggtcattacccgggttccagcccagcaaagcgaggaagtttacgacagcctcggggaagtagccactctcacgatagcccgatgaaacatcacccgtcttcggatcgtgccattccaaggggaatacagggaagcccagacgatcgccgtcacgcttgctcaacttaccgttaccttccggtttcaacagcaacgacagatgggcgaaactaggcatcgtatcttcccaaccgaagaaacgatataataatacgtgaagcggcgcgctcggcaaccactcctcaccacggatcacatgggtaacctccatcaaatggtcgtcaacgatattcgccaagtggtaagtaggcaattggtcggccgatttatataataccttatcatccaagatagaggagttgataacgacctcgccacggatcaagtcgttcacgtggatatcctcattcggctcgatcttggcacgaactacgtactgatgacctgactcgatcaggctctgaacctcttccggagaaagcgtcaacgagttgcgcatttgcgaacgggtagaggcgtcgtattggaaattggcgatctccttccgtttctcctccaactcggcaggcgtatcgaacgctatataagcatggccatcgttcagcaattgatcgacatacttcttgtagatctcacgacgctcgctctggcgatacggaccgtagttgccgccgaagctcacgccctcgtcgaacttgatacccagccaagtcaaggcctcgatgatatagtcttccgccccgggaacgaagcgttgggaatccgtatcctcgatacggagaatcatatcaccgccattctgtttagcgaataaatagttgtataaagccgtgcggacacctccgatatgcagcgcccccgtaggactaggtgcgaagcgtactcttacttttctttgagtcataatacttacattctataataatgcggcaaaagtacgcctttttttccgcttagtgaagttttttacgtatatttcggacgcaaaaaggaatctatatgaaacagaagaattacaatataccgaccgtggtctacttcgtggtgaccgcgttacttatcgcctacttcttccctcgggagggaaaattccgttatcagttctatgagggcaagccttggagatatggattactcaccgccccgagcgatttcccgatctacaagaccgacgacgaggtaaaagcggagaaagacagcgtactccgtaagttcgagccttattaccgcatgaaccccgacatccagaagcaagaggtcgagaaactgcgtgccaactacaataacggcaataacttgcgaagcaaagtatcccccgcttacatgcagtatatagagagcagcctgatcaacttatacaagaacggtatcatctcgtcgcaggatctggacgagctacggaaagaggaatactcccgtgtcaacctcttggagaacgccgtcgcgcagcctcgctacgtgagcgacttcttcaccgtgcgcaccgcctacgagttcattatcaacaactgcccgccgcggctggacaaatcgatcctgcaatcgtgtgacatcaataactacctcaccgagaacatatcctatgccgccgacatgtccgacaagatcaaggaggatatgctacagagcgtatctatcgctaacggtatggtacaagccggagagcgtatcgtagaccggggcgagatcatcgacaaccatacctacaacgtgctccgttccctaaaggccatacacgaggccaagacggggggcacgcagacacaaggcatcatactggccgggcaattcgtgctcgtcttcggactgatgttctgtttctggctctacctatggtctttccgcttgaagatattccataaccggaagaacgtactattcttgatcctctgcatattcgtgagctgcatccttacggaactatgtgttacctacgcgttattcaacgtatatatattgccgttcgccatcgtaccgatcgtggtacgtaccttcttcgactcccggacggcgcttttcacgcaccttatcatcgtgctgatctgctcgttgatggtacctttcccgcatgagttcctgttgctacaaaccatagcgggcatggtcgtgacgttcagcctgagaaacctgagcgaacgttcgcaactgatccggtgcgcattcttcatcttcctctcgtacgccatctgctacatgagcctcacgttgttccaagaggcgaacctgaataagatcaactggatgatgatgctctatttcggcatcaacttcatcctcgtcatgttcacctacgtattggtatatatgctggagaagacgttcggctacgtatcggacatcaccttggtggaactgtccaacatcaacaacccgatcttgaagaagcttagcgagacttgcccgggcacgttccagcactccttgcaggtatccatcctcgcttccgaggcggccgccaagatcggcgccaacgcccaactggtacgtaccggcgccctttatcacgacatcgggaagatgagcaaccccgtcttcttcaccgagaaccaatcgagcgtgaacccgcataaccagttatcgttcgaccaaagcgcgcagatcatcatcagccacgtcaccgagggcgtgaagatcgccgagaaggccctgttacccaaggcggttatcagcttcatccgtacgcaccacgggcgtggcaaggcgaagtatttttacaactctttcaagaaccaatacccggacaagccgattaatgacgagctattcacctaccccggcccgaatcccttctcgaaggagaccgccgtactgatgatggccgattccgtggaagccgcctcccgcagcttgaaggaacataccgaagagagtatcagcgccttggtgaacaagatcatcgacgggcagatcgccgacggcttgctaaagagcgctccgctgaccttcaaggacgtggagaccataaagagcgtattcgtagacaaactgaaaaccatgttccatacccgaatcagctatccggacttgaaaaaacaataattatcaagcagataggcatacagccatcggcacagaaccataatgcctattgtaaggttcttataatcgcagttataagcatcttacaatgggcattctagcaaccttacgatgggcatcgtaataatcggcaatattccaacaacccggcgcaagcgtcttccaatagatccaagaccagctcgaagccctcggcaccgctataataaggatccgggacgtgatcgtacaacttattccgggagaactcggtcatccgatgtatcttagcgacggattccagatcgggagccatccgtttcaaatccgttatattttggtcgtccatgccgataatcaaatcgaagtcatggaagtcccactgacgtaccggacgggagatcgaatccaacgaatatcccctgcgagccgcatgcgcccgcatccttgaatctgcccggtctccctcatgatagccggtgatcccggcggaatcgatctcgatccgagcttccagccccgcatccttcaccaacttcttcattaccgcctccgccgaaggggaacggcatatatttcccaaacacacaaacaacaaccgtatcttttcctccttcatccctaagctcctttcctttaattttcaattttcaattctcaattctccattttcaattctcaagccgggtccacatcataatgaaccaacaactgcttaaatagcgcatatccctgcatctccgcatgaatcccctccaatatctcacgaagcggagcgatcccggcggatatctcgatcttcaagacgatcttcttgatatgaagcgtctgtacccgagtgataggcggcgtaaccggccccaacacccgctcacccaaacgagcacgaagtttctcggcgtataaagcagacatttcctgcaaagcctcctcattccgacttcgaaggatcaagacgatcaaacggtagtaaggcgggtaacggaacatactacgctcgctcaattgcaagctcaccatttccttataagcaaaatgctgcaccatacggatcaaaggatgctccggctgagtagtctgcaagatcaccgtaccccgcttatctcgtcgtccggcacgtccgctaacctgtaccatcaattgataagcccgctcgtgcgcccggaagtcagggaaattcatcaggctatcggcactcaggattccgaccacgctgacattcccgaaatccaatcccttcgacaacatctgggtaccaatcaagatttgtgtcttccccttctcgaaatccgagatgatccgctcgtaagccgtgcgggtacgggccgtatcgaaatccagccgctccaccttcgccgctgggaattgcccagcgatctcctcctctaccttctccgtaccgaagccttgcatcttgaactccgtccccttacactcgggacatacctgcggcaagcggtaggtataaccgcaataatggcaaaccagctgattatgcgccttgtggtaggtaaggctaacgtcgcaattcacgcaacgaggcacccacccgcaccctcggcactcgatcatcggggcgaatccccggcggttctggaataggatcgcctgctcgccccgggatagggcctcccgcaccttctccaccaacagaggggagaaaagggtatctttcatgatcttcttgcgctttagctccttcacgtccaccgtaataatctccggcatcaagcaatcaccgtagcgggtagataactcaaccagaccgtatttccccgccgtagcgttgaaataagaatcgatggagggagtggcggaacccaataaggtcttaccgccgtgcatacccgccaagacgatggcagcgttacgggcatggtaacggggtgccgggtcctgctgcttatacgtattctcatgctcctcgtccacgataatcaagcccaagtccttaaacggaaggaagagggacgaacggacccccaataccagcataggctcgtcgttatgcaatagcttattccaaacttccacccgctcgttatccgagaacttagagtggtagaccaatagcttatccccgaataatttcgccagccgttccgtgatctgggtcgtgatagcgatctccggcaacatatataaaacctgccgccccagccgcaagacctcatggatcaaacggacgtatatctcggtcttaccactggaagtcacgccatgaagcaagcagacctccttcgtcttgaaagcctcatggatctctccataggctttctcttgcgccggactgagcggattcggctcttgcaagcggcagacagatacttgcaaacgacccacctctttctcgtaactctccaagataccccgtttcagcagcccctccaataccgcagaggtataaccactgcgttccaatagctctttcttggaaagctccttcgataaagcgggattcaaggtatggcttaaatccaagaagctgaccagcagaagctcttgcttcttcgctcgtttcaaatcctcgaacaccgcctgtaatttcgtctcatcccggtaagcctcggccaaacggataaacgcctgtgtcttgggaacgaatcctcgctttagctcctcgctcacctcgaccgcccctttcaccatcaaggaagagacgatcgggacaacatttcgaagaccggtcttcttctccaactccgagatcgtcaatttcaaaaccccgctaaaagcatccagtaccgcttgctcgttcgggcgcaagggggcggtggcctcgaaatcctcattataagtaaccgccgtctcgctttccaactttaagccggaaggcaaggccgccttatacacgtcgcccagcttacatatataataagaagatatccatttccagaaacggagttgcggacggcggagcaccggcgtggcatccagcaaagcgtagatctccttcgtctcaaaatcggataccggttcccggtcgtgtacctccatgacgatagccgtataatatcgtttcttcccgaaatgcacgatcacccggcaaccgggagtcacggctctctccagatcttcgggtatccgataggtatagctattctccaaaggaaggggaagtatgacgtccgcgtatttcattcaaacaggtgtttcattacgagcccaaaaataacaaaaaaggccggacttctaaagcccagcctctctcattttattttcacctatttagaacaagatcgctgccgtgatagaccacccacggttctttccggcaccgtcggagaggttcaccttctcaatactatagttatcagtcagtcccagaccataattgaaacccacctgcaagtggctgatcagttccacgccggcaccgaagttaagacctgcgctgaaattcttcgccttcacctgatccgctacggaacccgggatatcccaaaacttatcaccgcctacacggaaaccgatatacggaccggctgccagatacgccttgacgatcggtaagccgaatttccatttcaagttgaccggaacatcgatataatccgtcttcatcgaagtcttcaccccgccagccgaggtcgtttccaaacccttttgcgaatacaacactgccgcatcgatcccgacacccaccaacggtaaggtcgtctcgatcatcggacccacttggaagccggttacgttatccgctttcaacacgtccgagttgaaatgaacagacgatatattcacacctcccttgataccgaatttaagctgagcgttcgccggaagcgccatcaacgctagcaaggcaaccataacaagtcccacaattttcttcatattcatacttcttttgttaattactcgttgcaaataaacgcacttttctaataataaacaaatattctctatagagtgttcacggaataccccagtcctttaaacgcaaagaaagcatgcatcttacacacggagctcatcccgtcggtcagattcatgcttctttccctaattattatggcaaaataattatccgaaaccatgagacgacttgataagaaaaccttggataaagaatagtaaaaaccggatacggttcttgcgttctcttccggcctttcctcgaagccgtcgaaaatatacacgccttgcaggtcttctgacttacttccggtcttaagcgccttcccattcacttgaatgaacagtggcaacagtattgctcaacccgtttatgaagcttacagcagcgggactgtccgggattctcacccgattcccttttaatccctatccggcgattgccgaaagggaacaaagcatgtagcaaagatacataaagttttgatgtagcctaacactttccacaaaaaatatccttatattcccggttcctgatatagcataaagccgccccgatagccgtgcgatattcggcatactccggtatcttgaaatggacatcgcacatctcctccagacgggggaaaatatccgggcattgtggcaagcgagtcaggttaccgatcaatacgatattcttgatatcgccatttaacgaggcgaaaacagctccttgtccgatggtctgcaagaccatatgaacgataccgagagcgatatcctcaaccttagcgttcgcgtccgcttttccgaaaatagaggctgtcacgtccagcggcaggccgggtagcggatgcggcgtaatatcccggatatgcaagtcgatatcattcaaggaaccgtgctcggccaaagacgctatttggtgaaagtcatgcgttttcaataatagcttagacaagccgaggattgttccgccaccgatacccaatcccccgatatgctcgatcgtggagccttgtaccttgacaaaggaggtacccgttcccatgctgaccaccaatagactgtccagtcccgtattatattgcgcccctagcccattcgcaaggaactcatccgtcttcgcagttggtaagccatataaaggttgatcgatataggcgctacctacacccgtcaagatcactttctctatattcgagagcgagatgttattatcataaatatacttaccgaaggctccgaataaagaggttaccggatcggtagctttcacgaacatcgggttcttgatcttcttatcctccacgccgacgatcttggtcgtgctacctcccacatctatacctataacgattcccatgattctttccctttttaattgaataatcgctacaaaagtacataaacccgcatacaatactaaaaaaggccggacaaaatcaattgtccagcctctctttatttaaaaaccgtaaggtctaaactctatttattcgcctaacaagatctcaaggatctggcaagctgccttcgatacggaagtacccgggccaaagatagcggcaacgccagccttatacaagaagtcatagtcttgagccgggattacacctccagcaataacgatgatgtcctcacgacctagtttcttcaactcctcgataacctgcggaaccaacgtcttatgaccagcggccaaagaagaaacgcccattacgtgaacgtcgttctccacagcttgacgggcagcctcggccggagtctggaacaacggtcccatatctacgtcgaaaccacagtccgcataaccagtagcgacaaccttagcgccacggtcgtgtccgtcctgacccatcttagcgatcatgatacgaggctgacggccttctttcttagcgaattgctcgcaaagctcgcaagctttctggaagtctgcgtctttcttagtttctgatgaatacacgcctgaaatagttctaatgattgctttataacgacctacaaccacctcgcaagcatcggagatctctcccaatgacgcacgcaagccggcagccttaacagccaactctaataagttgcccttcttcgtcttcacgcactccgtgatatcagccaaagctttttgaacagcggcttcgtcacggttagcacgcaactccttcaaagcggcgatctgctcgttacgtacggctgtattatcgatctcaaggatatcgatcggatcttccttcggcaaacgatatttgttaacaccaacgatggtctgaacaccagagtcgatacgagcctgtgtacgagcggcagcttcctcgatacgcatcttaggaagacctgtctcgatggctttcgccataccacccatgctctcgatctcttggatcaatgcccaacctttatgtaccaactcattcgtcaaagactctacatagtaagaaccagcccacgggtcgatctccttacagatcttagtctcttcctgaatgtaaatctgtgtattacgagcgatacgagcagagaagtcggtcggcaaagcgatcgcctcatccaatgcgttcgtatgcaaagattgtgtatgtcctaatgtagcggccatagcctcgatacaagtacgtcctacgttattgaacggatcttgctcggtcaatgaccaaccggaagtctggctatgtgtacgcaatgccaatgatttcgggttcttagcgccgaagctcttcacgatcttcgcccacaacatacgagccgcacgcatcttggcgatctccatgaagtgatttacaccgatagcccagaagaatgacaaacggggagcgaacgcatccacatcgataccggcgttgataccggcacgaagatattccataccgtcgcacaacgtataagccatctcgatatcagccgtagcaccagcctcctgcatatgataaccggagatagagatagagttgaacttcggcatcttctgagaggtgtactcgaagatatcagcgataatcttcatggagaactcaggcggatagatataggtattacgtaccatgaactctttcaagatatcgttctggatcgtaccggccatttcctccaacttagctccttgctccaaacctgcgttgatatagaatgccaataccggaagcacaccaccattcatggtcatggaaacagacatcttgttcaaaggaataccatcgaacaacactttcatgttctccaaggaacagatagatacacccgctttacctacatcaccaaccacacgttcgttgtcggcatcgtaaccacggtgagtcggaaggtcgaacgcaacggacaaacctttctgaccggaagccaagttacggcgatagaaagcgttagactcctcagcggtagagaaacctgcgtactgacggattgtccaaggacgcatagcgtacataccgctgtacgggccacgtagataaggaggcaaaccggaagcatagttcaagtgctccataccctccaagtcttcttttgtatatacaggtttcacctcgatatgctcgggtgttttccaattgggctcgatgccattggcttttgcccattcggcagcgtttgtagctgcgaatccggcattctttatatctatgtttttaaaatctggtctcataattgtttatacttaagcgattcctaatttagcgttgaatgctttcaatgtctcaagcacattgctctttacatttacgaactggtcgataccttgagccttcaagtcgtccgcgcaagcaggagctccggctacaacgaattcggcacgtccggccaaagccttgtaagcggcaggagcgaattctgcatactcgtcatcactagagcaaagaaccacgatctcggcacccgccttgacagcagcctcaacaccagcctcaaccgtatcgaagcctaagttatcaattatcttatatccggcacaagcgaagaagttagcggagaactgtgaacgagccaaacgcatcgccaagttacctatcgtcaacataaataccttcggagtcttgccactcttctctgtcgtcatacgcaaagcctcgaattcagaagcgccgcgagagaaatctagagccgggatcgttgcctcaccgcaatgaccaccgccacaacagcaagaacctttttcttgaatcttatcggcagctacttccgtgaagttaggatactggttagaacccaacaatatctcacgacgggtagcaaccgctttcttacgagctacattcgaagcgttaacggcattttggatctcacctgcgttcacggcaacggagaatcctcctttttcctcaacctccaagaacaacttccaagcgacatcagccaaggaattcgtcaatacctctacataataagaaccggcagacgggtcaacgaccttatccaagtggcactcttccttcaataataattgttggttacgtgcgatacgctcagagaaatcgtccggagtctggtaaatcttatcaaacgggcgaaccgtgatagagtctacgccggcaagagcggcagacatagcctcagtttgagaacgaagcaagtttacgtgagcatcgtaaaccgtcatgttccactctgaagtctgtgcgtgagcaaccatcttgcaagcgcattcgcaggccggcttataagcggctacgatctcggcccacaaccaacgagccgcacggagcttagcgatttccatgaagtagttagagctgataccaaaattgaatttgattttcttggcaacctcgtcagcggtgaaaccagcctcggtaagttttgccatcaattcgttaccccaagccaaggcgtaacctaattcctgagaaatgtaagcgccagcattgttgaaaaggaacgcatttacagccaatacacggtagttaggcaaagcctgtccagctttgagcacagctgcggcaccttctacccactcactgttttctttaccttttactaaaggtttcttgaaagcgtcatagtttacagaaccgtagcacttctctgcgtcgacacccttgcctttgaagtagtcagccaagataccgatcaacttctccgctttgcagttgcaagtgttgaagttcaattctacggaagccggacaaataccttctaataaagtagctatattctcctcgttcacctcatcacctttgatgatgaacccaagagaagtaacacctttcgtcaaaaggtcaagtgctttctcgttagcacccttgaagcagcaaacttcaatgttctggcgtaccttccaatcgttgtctttcttcgttccacgaacataagggaattcaccgggaagagactctgtagtctttaaaccctcgatgtcttctgcacgatagaaaggatttacattaaatccttcgcctgtcttccaaacaagctttttctcaaacggtacccctttcaggtcggccgttatcttcgccatccactcttcagtagacacaggagcgaattctgagaaaagtttttctttaagttctgccataatattagttgtttattaaactggtattagtaatgttcaatactattttgttcaattacagatggcaaaggtagaataaataaacagtaccgacaatgaaaaaacaatgaaatcgcaactacttttaacgccttttagtggtattctccccgttttcttggcattttgataaaaaacacactttttcttcaaaaaaactcggttcaactattgcagaattaaaaaatatatctacctttgcatcgtcaaacaaaaacaatgacacctaaatggtggattcgtctaacggttaggacacatgcctctcacgcatgtaatacgagttcgattctcgtatccactacaaaagctctcaatctattggttgggagtttttttttatataccttcgctacccgatagtatcctaaatcttttattatacactaaattatatcatgaaaagtaaaaagaccgtctttctgaccggagccaccgggacgatggggcatgccggattggtcgagttgtccaagcggctagatcgttttaatataacacttttggctcgcccaagcaaaatcaataaagagaaattagccgcatatgaggccatggcagggatccgtatcgtttggggagacttgacaaattatcaagatgtcttaaatggagtaatgggggcagactacgtattgcatgtaggtggaatggtttccccggcagcggattatttccctaaaaaaaccttgaaagtaaacacgaccgccgcccaatatatcgtggatgccgtaaaagcacaaccgaactcagaccggatcaaggtagtctatatcggctccgtggcgcaaaccggccaccgtaacgcacctgttcattggggacgtacgggagatccgatcaatataagtgtctatgatcattatgccatctcaaagacaatagccgaacgtattttcgtggagtcgggtattaaacattgggcgtgccttcgccaaaccggtatcttatgccccgaattattattcaagggttcggacccaatcacattccacgtaccgctagacggcgtgctggaatgggctaccgccgaggattccggtcgcttactagcgaatgtatgcgagaaggaggtgccggatgagttttggaaccgtttctataatattagtagcggcccgtctttccgcctgacgaattatgagtttgagagtaaattgttaaaagcgattggctgtcccgccccagagaaaatattcgaaccgaactggttcgctatccgtaatttccacggacaatggtataccgattcagatctattggaaggatatctgcatttccgcagtaaccaaacttgcgacgattattttaaatggatggccagccaagtcccttggtatttccacctagcaaagatcgtccctcctatcttcataaaactgggtatgggagccatcgctaaaaagccgggactgggaactcgtaactggatcaagaacagacaccaagatcgtatatccgcatattttggctcgtatgaggattggcaagcaatcccgggttgggataagatccggacagaacgcccctccgaaacacccgtctttctggatcatggttatgatgaaagtaagcctaaatcggaatgggatatcgaggatatgcgtaaagccgcggaattcaggggaggaaaatgcttgtcaccggtcatgacaaaaggagatttatcgactccactcgattgggaatgccaattcggtcaccgttttaaggcctctcccacattagtattattaggaggccattggtgcccggaatgtttacctctcccttggaattacgacgagatcgctaaaggaaatccgttctttgcccaagtatggtatccattccacgataaaaaggaacacaatgtatatgatgaatccatattcactgacttcaaggaataaaattcaacgcatcaagagatttttgttttttagattatttatctcaacgcaacatacttttaccggatattatctgttataacaatataagcactatataccataaacataaaaacagattttatcatgacaaaaggatcgatcggattaaatgcaggagctatctggaatttgctttcagatggccaacattggagttttgaggcgttgagagcaaaatccgctctaacagatgcggatatatggtccgctatcggttggctcgctagagaaaataagattgaaattgataataccagcagccaccctatcttctgtccgggtaccaacttttatttttaaatgacatttatgatatttcattgcgaaggatttcactttcttcgcaatgaaatcttcaaaaaaacacttactttgtaaccctaacgaaataaaaacaatacgattatgaatcctactttcggaacttccattctttcttggataccacctatgtggacaccagaagccggtcttttcgctatccagcaagcatctgctgccggttttgatttactggaaattttgttgcctccttccatggagttcgatgctccaaccgtaaagcgacaattgaaacaacacggattgaaggcgacttgttctctcaatcttcccaaagaagcgcatattcctttttatcccaagaaagcgacttgtctgatcaaggaggcgctggataaagcgagcgaactggaggttgattacttgggaggtgtcttacattccggcatcggggtcttttccggcaaacagcgaacacgggaagaagagaatacgctttgtgaggtatgggcagaagttgccgaatacgccgcccgatctggaatcacgatcggtatcgagccgatcaatcgctatgaaagttatatgtgtacctctgcggaggaagtcttgcgctttatcaaacgcataaacgcaccgaatttgtctttgcatctggatactttccatatgaatatagaagagacgagtttttatgaaccggttattgcggctggcagccggcttcgccatattcacatgactgaaagtgaccggggaatgctgggtgagggaaacgtacgctgggatgatttgttccggggactacaggaaatcgatttcaatgggaatttagttttggagaatttctccaattctgttcccggtatggcggaagccgtatctttgtggcgtccgtctaaatacaatgccgatgccttagccaaaggcagtctcgccttcatgcgtaagatggcacgcgaatatcaataaagcatcaattaccgcaagaccgccgcagtattaccgcacggcggttgcagtaatgtcatgtcaaatgagatggtagcatcaatcttatcatttaaatagctgctgaacgacagcgctatccccgtcattcggagcaggttgtatattcaataaacgggcaatcatcaagtaaaggttcacgttcgccatttgcgggacctccgcatgtctcttgaacgagggacctgccgcatagaatatggcctccatctccggcgtaaaattatcgtaaccatgtgtcgccgcataacggggagatgatttctctcggaattctacatacgttccaatatgtggagaaacaactaagtcactaactcgaggattctttccgtaaacaaatttctcaggaatctcgtttttcttccatacggttatattcggcactttctgtaaaatcgcataggcagtatccacataggttttcttgggatataataatgtaggaacgccatcaaaaacacaatcgaaactatcccggggtagataatcattcaagttcacatatttctcgggataataggtggccattccatgatccgaaagaacgataaaatcgatcttatcgaaaatatccaactgacgggcttccgtgaagaaatgattcaagactttatccaagttctccaccacatccaaggtcgccgacgaatccggggtagcggaatgacctatcgcatccggttcttccatataccacataatcaaatgaggacgcacatcttccggcaacttcagccaagatatcacggaatcagcacgatctgaaaaaggaaccgatttatcaaacggcttccatattgaaggctggccactctctaaaggcacctcactacctacccaatagaacgaggcggtacgaaccccttggcgttccgccgtattccaaataggttctccaccataaaattgcggatcaagatttcccatccggtatgagctgtcaagctccgcgtcataaaagaaattatttaccaaaccatggtgatccggatgcaatccggtagccatgctataatgattcgggaaagtcacgctgggataacacgggcgaaacgtggagcgaacccccacattcgccaaagaatccaacgtcggagtatgagcacgtgacggataatcagagcggaaaccgtccattgataaaactacgacataacgatccgattgttttttcgtttggcaaccggtaaaagccaatgaacaaatacaaaagaaactaacgagtaagaactcaatacgattattccacatatcattaaattaaaaaagaggtccacaaagatagtgaacctcttctaattattaaattttatctaatgaaagatttttcttttagaagatatacttgataccgaattgcatctgccaacgagacacatcgttcaaattatccttgaaggtttcgtccaaatctttcgccatcgtatacttcaacgtatagttgttcgccgcactcgggccttgtcctttcgggatcgtcaagaactgatattgctgattacccaaaacggttgtttgtaccacaccccaattacgattcaacaaattcaagaagttagcgatattgaaactaaagcgcaaagtatgtgagcgaccattcttctggtaaatctttatatcatgagaaacgctcaaatccaattgattcgcaaacggagcgacagcaccgttacgttcggcatactcacctctatgtttgctcaaataaggatcttgctcgataaaggcattcatcgctttccatgcatcttcttggctatcgaaatcgcccggtaacaaatgatcttttacctcgtcaaaattcgcggggatatacatcaagtcattggagaactgagaatcgccattcgcgtcaccattataacaataagaataacggaacggacgataacgctgataaatcaaaccaaaacttgttgccgcatatttactccagttagccgtgtaagaagcggacaataacaaacgaccatcaaaagaacctgccgtataacctacttcttccgcatttccgtccaaggccgcacggtacttccaagcggaagtcgccacagacgatgttccgtctgttacacctctagactgcccgaaagagtaagatccattcaaatacaatcccttcaggattccatcaacaaagtttttctgcaactggaaggtcgtataaagcgaatgtcctttgctggtattacgcagcatcacgacatgattcgcagccttttgatttccttctctatcgctataatagccattataatatggacgtgcattacccgctccaccgtcatttacaaattgctcggtccgatacaatccgatattgtcatgataaatagcgttaatgtcttttgaatacagcaactctacggtagcgacccaaccatcaccaaacttataatcggcagcgatattacttttccataagctcggatatttaaagtccggatccgtaatcgctatatccgaacgtgtagcgctaccttcagccggtttataagtatccatatttccggtgaaacctagtgaaggtctgccgtcgctaatgatattgtcatttttatcctttaccgcccgaacatttaggtcaccaaacagaacaccattattgccggcttgattactgatccatacataaggaggagtacccgtgaagagtcccgtaccaccacgtatctgtaagcttccattctcatcgtcaaacggtttgtagttaaaaccgaatcgaggagaaaactgaggtttggcgttcggatatttagaaacatcgatcttgatgccatcccgataggtctcggcggcgactttatcattcgactgcaaatcagtcataaagaacggaacatcgatacgtaaacctaacgtcaagttcaatttatcacttaccgtccacttatcttgggcatacaaacctaactggaatacatttatctcagcgaatggaaaatcatccgtcatcgaatatctttgcgcatagtattgataccccgtagaagaagagttcgttatacccgtcacattggaaccaaatccaaaatctttcggattaaactcacggatatcaaatccttgtacacttccgttatgagcggccatgtattgttttgtagccaatacgttgaacttgaaatcatcgacagaattaaacacccaagaacccggatagttttgagcgaaaccattcttaaaggcacgatagtcactttgcgttccaaccgtaatctgatgtttgccaaaattcatcaagaagttatcctgtatctgccagatatcagtgttcaactggttattataggagtttgcctcggttccgaaagttgtataagcattgttaccaccatccaagatatccacttgcgggaagtaaccgccatccatatcgcgataatcacgcaaacgggaataaccgatcttcaaatagttagacatacggtcattaatggtcgtattcaagtcggccatccaaatattgaagttattattcgtccggtagaaagaagaagagaacggaatagcgaacgcattcggtccacgtccgttattcggcgcaccggaagtagaagggttattcgtattaaacgatttcaaataataatattttaagctcaacacattatttgagttgatattccagtctaaacgagccgtgattcgatccgcttgagtatttgtcttattcacgtcgaatttacccggattatacccaagctcatcacctaagaaatcagataaaccctgcaagactgtcgcatccgccgcagaattagcggtcgtataagaaatcggttcctcctggcgatccatctcaccattgatgaagaagaataacttattcttaatgatcggaccggataaactgataccgtattggtgattagagaactctgaaacaccaatcgtctcatccttcacacgatatcccatcatagacggactcttcgtgtacatatatacagaagcatgaaactcattcgaaccggatttcgttacggagttaatacccgcacccgtgaatcctccatttcgaacatcaaaaggagcgatcatcacctgtacctgctcgagcgcctccaaagaaatcggttccgtaccggaagctccaagagcagaagccagaccaaacgagttattaaaggaggcaccgtccaccgttacattattaaaacggtaagagacaccgccaaaattcttaccgctactcatcggagttaatttcacgaaatcgtccaaagaacggttaatcgtaggcagcttatccatcttctcacgagtgatgatttcctgcgcacctgtacggcttcctgaaataatggggttcttatccgcaaccacgactacctcgtcgagagcttgggtatcttcccgcattactacattcagtttcagatcctcacccaaaaccaagtttattcctgtccggctctccgtattgtatccaatataagagaactctaccacataagggcctccgatacgaaggttgttaaaagaataagaaccattcggctgggtaatcgtgtagtattcggtacccgttggcgtatgcgtagccttgatattcactccgatcatcgcttccgatgatgtatccgtgactttaccactcatactcgccgtcgtcacctgagcatgtatggatattcccacgcacaacaaaagtaacgttaaaagtagataagttttcctcatacaagaagtatttatatttaaaataattataacatttttgtatatcgccgcaaagatagggattagatatctctttttgtcacaaactatatataatattcatagcattaacattcctcacacagatctccagattattattttcaaccaatcacatccataatccaacaatatgcaggaaaagcgtctataattcttttaaatcaccgcccaacagggaatgttagttaagaatcatcaaattaaaaatttcataaagaaccttcttgttttgccaatacaagccatccatctccgaataaggacattactcaattccgccccgtcacagcaacttcatgaatatgaaacaagtattaaataagaaacatacaatgatattaaaaaataacccataactttgcgaaagtttttattacattaactattttaaattatgagcagacatttacagacgctattccttttagctgtactgagtttcttgtttgtcatcccgacacaagcgcaggtaacaacagccagtatgagtggaacagttatgtttcaagatgaacccgttattggtgcgaccgttttggcggttcacgaaccttctgggacaaattatggtacgatcacgaacgttgacggacgcttttccttacaaggtatgcgtacaggtggtccatacaaagttacgatctcttacgttggttatcaatctgccgtttattccggcattaccctgcaattgggagagaactacaacttgaatgttaagttgaaagaatcttccgagaccttggacgagatcgtaatcacagcggcgaaaacgaagttcaatacggaaaagacgggtgcgacaaccaatatctcctcgtcacagatcacctctttacccaccattaaccgtagtatctccgatatcgcacgcctttctccttatgcctccgacatgagttttgccggtggcgatggccgttccacgaactttacggtagatggagcgaactttaataacaacttcggcctttcggataatcttcccggaggcggtaacccgatctctatggacgctatcgaggaagtacaagtggtaatcgccccgttcgatgtccgccagacaaacttcattggtggcggtatcaacgctatcaccaaatccggaacaaacacattcaaaggttccgcttacacttacttccagaaccagaatatgcgaggaaactcaatcgatggagaagacttgggcgcacgtgctaaggaatccaaaacgatttacggagctacgttcggcggtccaatcatcaagaataaattattcttcttcgccaatgtagaagtggaaaaacaaccgcaacaagtgatcaaatggagagctcgtactgaaggagagcaaccggacgagaataactacatatctcgcactacactctccgacatgcaaaaggtatccgatttcttaagagataaatatggttatgatacaggatcagccacgaacttccccgcagacgaaaagaatttgaaattgctaggtcgtatcgactggaatatcacgaatggccataaattgagcgtacggtacaactatacaaagaataccgcatggaacgctcccaacgctaactctatggatggtggttccggctctcgtctgtataatacaagccgtgtaggttaccaatccatgtcttttgccaacagcatgtattcccaagacaataaagtgtcttccgtatccgctgatttgaacagtcgcttctctgataagatttccaatcagttacttttcacttatacggatatcgaggatatgcgcggaaccaactcttcccctttccccttcattgatatcttggcaggtaaagatgcggaaggtaaccaaatcatggagccttatatgagtgccggatatgaattatttacttacaacaacggcgtgaagaacaagatcacaagtgttatcgataacttcacttactttgccggcgaccataagatcacagctggtatcagtttcgagcaccaacttgctagcaatgcttatatgcgcaacggcacgggatattatcgttacagcagcttagatgatttcttgaacggtgccgctcctgaaacgttcgcatggacatacggttacaacggtgtttccgacccgaaagctcaggttacttttaaccagatcggattctacgcacaggatgagtggaacattcgcccgaacgtgaagttaacttatggtatacgtttcgatgatttaattttcgacaatagcgatcttcaaagaaacgacgcaatctacgatcttgatttcggaggcaaacatatcgacaccggcaaatggcctaagtctagaatgcaaatatcccctcgtgtaggtttcgtttgggatgtgttcaaggataattccttaaaagtacgtggtggtacaggtatatttaccggacgtttacccttggtattctttacgaatatgccgacaaactcgaatatggtacaaaatgccgtagtattcggcacaaaatatgagaatggaattgcggtaagtcatgattcccgtctggatcaactggctggcggcatgattacgaatgtagacgatgcgatcaagaaattcggccttcctaccacgatagagaatccggttgccggttctaagatctctggcgtaaaggacaacttcaagatgccacaaatatggaaaacctccttggctgtagattatcagctcccaacttccttcccattatccgtaaccggcgagttcatctataacaagaacatcaatgccgtaacccttgagaatatcaacatcaaggacccgtctaattgggaacattttaacggagcggataaccgtttgatttatccatctgattatacgtatgtatccggtaagaatgcggttgtattaactaacacatccaaaggacatggttataccgccaatgttacgattaacgctcaacccgtagaggatttgaacatgatgttggcttatacgcacacggaatccaaagaaatttccggtcttccgggtagcgaccctgtatctacatggcagggaatgttaacgatagacggaccgaatttcgcgaccgtacaacgttcacggtatgtagtgcccgacaaggtaatcgcagcggtcaattataatctgcccttccgccataaaggtctgctcagaaaaacaagcttaaatctgttctattccggttattccgcttccggatatagcttcgcttatacaaatgatatgaatggtgacggtatcaataatgatatgatgtatatcccgaaagatgatagtgaaatcaaattcaagaatgaagcagatagaaccgctttctggaacttcgtagaccaagattcttatttaaagaatcacaagggagaatacgctgaggcttatgccgcacgtgcaccttgggtacatcgtttcgaccttcgtataacggaagatttctcattcaaggcaggtaaaaccgaacatcatttccaattgagccttgatttcatgaatatcggtaatatgatcaactcgaaatggggtgtaatgaagaacgcatcttcttccaacggttgccgtatcttgaaatatgaaggtatggatgataataagactccaattttctccatgtataagatcaatggtgaatatccgaccgagacttattcttataaccgtatctatactgaatgctggaaaatgcaggttggtatccgttacatctttaattaatcaagagatataactccataaaaaaggcggggaacaaattttcccgccttttctatttcatcatatatcctctcctcctcgcaaggcatccgctatatcttgatgccgctgggctaattcgtcctctccgatcgcccggaaaccctccgccagatattcgtgggaagccgcatgtttaggtttgatacttaccgcctgctggaaatccagaatagcttcatcgtaatatttgagcttcaataggcattttccacggttatagcgggccttaaaagatttcggacttaattttaccgctttgtttaaacaaacctgagcgtcgtagtcctcacctatatccaataaagtaacccctttgcgtacccaagcttccacataattcggattcaaattcaaggctttatcaaaacaacgaatagcggcattcgcgtcatgggccttcgttatgcactcgttacccatcaagtaatattcatgtgcatactctttctgggtctcacgaagcgaatgcaattcttccctcagagccttaatctgtgccttttgactattcaaggcttgcaatttcaaacgaagcagccgttgtaccatcggattatccaattcattccgtttagatacggcggcggcaaaagcctcgaccgcctctttcatattaccctgccgaaaaccctgagccgcccgaccatattgcaattccgcctcgctctctttgatacttttctctattaatgcttggttattgaatatttggctgaattctacgatctctttccggataaagatatcccgggaagagatcttgctttttagcaccaatccttccaatgaagtacaacgactcaacgccacataggtttgtcccccggcaaatacccctccggtcaaatcaactaccacccggctaaaagtcaagccttgactcttatgcaccgtgatcgcccaagccaaacgaatcggcaattgttcgaacgtaccgacaatctcttcctcgatccgtttctctttctcgttatatttgtatttataatttcgccatgaggtaggttcgaccaaatgttctacaccgctctccagcaagacataaacatttccattctcatcgatacccgataccataccgatcgtcccgttcacccaacgacgctcataatcattatcgataaaaataacctgcgcctgttccttgatggataaattcagctgggtaggtagtgaggattccggaaaatccccctcgatctttcccacggagacgtactcttctccgggaagctcggccaacttcttctcattgataaaatcaacctgatcccggcgagtggccaacgtgatatacatatcctcattctgaggctcgaaagacggaaaataacgaccgttcaacgtatccaactcctgttttctagcggcattattacgaatccgatccaatatattgataaaaacagaatcggtctggcgatacactttttgcaactcgatcggcactaaattaatgtccttgaacacacgagccgagaaaaagaaagggctcgcatagaacaaactcaatatctctttttgatccgacggaacaaccggttccaactggaagacatctcccacgaacaatagctgctttccgccaaaaggcaatcgcatattaccggaatagaccctcaagatacgatctacacaatcaataatatccgccctcaccatcgatatctcgtcaatgatgatcaaatcgacctccgcgataattttccgtttctccttcggatacttaaaaaactcaaagatacgaccatgagacaaacttaaatccggatcatccggcaacatcggccgaaaagggagcttgaaaaaggaatgcaaggtaacgccgcccgcatttatggccgctattccggtaggagccagcaccacatactttttcttcgtatgattgcaaatatacttcaaaaaagtagacttgccggtccctgctttccctgtcaggaaaacagactggcgagtgtgggtgatcagttgcaaggcatcctgaaactccttattgttcgtgtctaactgaaagtccaagtatataatttttagatgagacaaagctatgaaaatatttacagatcactctaataatatccctcaaaatatttggcagtctccataaaaatcacttattttgtgatatcaaattaatatcaaaaacaaatcatcatgaaagcaaccgaaaagacattcaacggactgagaatctcggggtttattgccctttttctcctattagctctatcgggtctctgctgctatttaatcgcaggcaccaacgagacttggagcgtaatcaccggcatcgtcggactctgcctgttagtggtttgtttattgggattcatggaaatcgagcccaacaatgcccgagtaatgctctttttcggaaaatataaagggacaattactgataacggatttttctgggtcaatccactttacagcaaaaagaaaatcacgttacgtgcccgtaacttagatgtccctcctatcaaggttaacgataaggtcggtaatccggttatgatcggggccgtgatggtatggaaagtcaaggatacttataaagcgatgttcgacatcgattcttcgtccattagtatctcctcgaataaatcattcatatcactgggagaatcctctgaattatcccaacgaatgcagaattatgagaatttcgtgcagatacaaagtgacgccgccatccgtaagatagctggcatgtatgcctatgattataacgagagcaaagatcccgtcaccttacgatccg
